US011186837B2

(12) United States Patent
Baum et al.

(10) Patent No.: US 11,186,837 B2
(45) Date of Patent: Nov. 30, 2021

(54) COMPOSITIONS AND METHODS FOR CONTROLLING *DIABROTICA*

(71) Applicant: Monsanto Technology LLC, St. Louis, MO (US)

(72) Inventors: James A. Baum, Webster Groves, MO (US); Lex Evan Flagel, St. Louis, MO (US); Gerrit Cornelis Segers, Wildwood, MO (US); James K. Roberts, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 204 days.

(21) Appl. No.: 15/373,377

(22) Filed: Dec. 8, 2016

(65) Prior Publication Data
US 2017/0183684 A1 Jun. 29, 2017

Related U.S. Application Data

(60) Division of application No. 14/207,313, filed on Mar. 12, 2014, now abandoned, and a continuation-in-part of application No. 15/130,684, filed on Apr. 15, 2016, now Pat. No. 10,167,484, which is a continuation of application No. 13/783,125, filed on Mar. 1, 2013, now Pat. No. 9,340,797, which is a continuation of application No. 13/226,353, filed on Sep. 6, 2011, now Pat. No. 9,238,822, which is a continuation of application No. 11/547,764, filed as application No. PCT/US2005/011816 on Apr. 8, 2005, now Pat. No. 8,946,510.

(60) Provisional application No. 61/782,884, filed on Mar. 14, 2013, provisional application No. 60/669,175, filed on Apr. 7, 2005, provisional application No. 60/617,261, filed on Oct. 11, 2004, provisional application No. 60/603,421, filed on Aug. 20, 2004, provisional application No. 60/579,062, filed on Jun. 11, 2004, provisional application No. 60/565,632, filed on Apr. 27, 2004, provisional application No. 60/560,842, filed on Apr. 9, 2004.

(51) Int. Cl.
*C12N 15/113* (2010.01)
*C12N 15/82* (2006.01)
*A01N 57/16* (2006.01)

(52) U.S. Cl.
CPC ........ *C12N 15/113* (2013.01); *C12N 15/8286* (2013.01); *A01N 57/16* (2013.01)

(58) Field of Classification Search
CPC .................. C12N 15/113; C12N 15/8286
See application file for complete search history.

(56) References Cited

U.S. PATENT DOCUMENTS

| 7,452,987 B2 | 11/2008 | Giese et al. |
| 2004/0126845 A1 | 7/2004 | Eenennaam et al. |
| 2006/0021087 A1 | 1/2006 | Baum et al. |
| 2007/0011775 A1* | 1/2007 | Allen ................. C12N 15/8286 800/279 |
| 2007/0124836 A1 | 5/2007 | Baum et al. |
| 2009/0188005 A1 | 7/2009 | Boukharov et al. |
| 2010/0122381 A1 | 5/2010 | Buehler et al. |
| 2012/0164205 A1* | 6/2012 | Baum .................... A01N 63/10 424/409 |
| 2014/0230090 A1* | 8/2014 | Avniel ............... C12N 15/1137 800/279 |

FOREIGN PATENT DOCUMENTS

WO  WO 2005/110068  11/2005

OTHER PUBLICATIONS

Walsh (Host Range and Reproductive Traits of Diabrotica speciosa (Germar) and Diabrotica viridula (F.) (Coleoptera: Chrysomelidae), Two Species of South American Pest Rootworms, with Notes on Other Species of Diabroticina. Environ. Entomol. 32: 276-285, 2003). (Year: 2003).*
Robertson et al (EW772216/C, published Aug. 2007), (Year: 2007).*
U.S. Appl. No. 14/207,318, filed Mar. 12, 2014, Baum et al.
Baum et al., "Control of coleopteran insect pests through RNA interference," *Nature Biotechnol.* 25:1322-1326, 2007.
Bolognesi et al., "Characterizing the mechanism of action of double-stranded RNA activity against western corn rootworm (*Diabrotica virgifera* virgifera LeConte)," *PLoS ONE* 7(10):e47534, 2012.
Du et al., "A systematic analysis of the silencing effects of an active siRNA at all singlenucleotide mismatched target sites," *Nucleic Acids Res*. 33:1671-1677, 2005.
Fire et al., "Potent and specific genetic interference by double-stranded RNA in *Caenorhabditis elegans*," Nature 391:806-811, 1998.
Gong et al., "Silencing of Rieske iron-sulfur protein using chemically synthesised siRNA as a potential biopesticide against *Plutella xylostella*," *Pest Manag. Sci*. 67:514-520, 2011.
Guo et al., "Protein tolerance to random amino acid change," *Proc. Natl. Acad. Sci, USA*, 101:9205-9210, 2004.
Hill et al., "Functional analysis of conserved histidines in ADP-glucose pyrophosphorylase from *Escherichia coli*," *Biochem. Biophys. Res. Comm*., 244:573-577, 1998.
Huang et al., "Engineering broad root-knot resistance in transgenic plants by RNAi silencing of a conserved and essential root-knot nematode parasitism gene," *Proc. Natl. Acad. Sci. USA* 103:14302-14306, 2006.

(Continued)

*Primary Examiner* — Ashley K Buran
*Assistant Examiner* — Wayne Zhong
(74) *Attorney, Agent, or Firm* — Dentons US LLP; Amanda Carmany-Rampey

(57) ABSTRACT

The present invention provides methods for controlling invertebrate pest infestations, for instance in plants, and related compositions and polynucleotides useful in such methods. More specifically, the present invention provides polynucleotides and methods of use thereof for modifying the expression of genes in an invertebrate pest, for instance through RNA interference.

18 Claims, No Drawings

Specification includes a Sequence Listing.

(56) References Cited

OTHER PUBLICATIONS

Ichihara et al., "Thermodynamic instability of siRNA duplex is a prerequisite for dependable prediction of siRNA activities," *Nucleic Acids Res* 35(18):e123, 2007.

Li et al., "RNA interference in *Nilaparvata lugens* (Homoptera: Delphacidae) based on dsRNA ingestion," *Pest Manag. Sci.* 67(7):852-859, 2011.

Lu et al., "OligoWalk: an online siRNA design tool utilizing hybridization thermodynamics," *Nucleic Acids Res.* 36W 104-108, 2008.

Mao et al., "Silencing a cotton bollworm P450 monooxygenase gene by plant-mediated RNAi impairs larval tolerance of gossypol," *Nature Biotechnol.* 35:1307-1313, 2007.

Margulies et al., "Genome sequencing in microfabricated high-density picolitre reactors," *Nature* 437:376-380, 2005.

Pitino et al., "Silencing of aphid genes by dsRNA feeding from plants," *PLoS ONE* 6(10):e25709, 2011.

Pleau et al., "Development of an artificial diet for the Western corn rootworm," *Entomologia Experimentalis et applicata* 105:1-11, 2002.

Pridgeon et al., "Topically applied AaeIAP1 double-stranded RNA kills female adults of *Aedes aegypti*," *J. Med. Entomol.* 45:414-420, 2008.

Reynolds et al., "Rational siRNA design for RNA interference," *Nat. Biotech.* 22:326-330, 2004.

Sindhu et al., "Effective and specific in planta RNAi in cyst nematodes: expression interference of four parasitism genes reduces parasitic success," *J. Exp. Botany* 60(1):315-324, 2008.

Steeves et al., "Transgenic soybeans expressing siRNAs specific to a major sperm protein gene suppress *Heterodera glycines* reproduction," *Funct. Plant Biol.* 33:991-999, 2006.

Timmons et al., "Specific interference by ingested dsRNA," *Nature* 395:854, 1998.

Upadhyay et al., "RNA interference for the control of whiteflies (*Bemisia tabaci*) by oral route," *J. Biosci.* 36(1):153-161, 2011.

Waterhouse et al., "OrthoDB: a hierarchical catalog of animal, fungal and bacterial orthologs," *Nucleic Acids Res.* PMID:23180791, 2012.

Whyard et al., "Ingested double-stranded RNAs can act as species-specific insecticides," *Insect Biochem. Mol. Biol.* 39:824-832, 2009.

Hu et al., "High efficiency transport of quantum dots into plant roots with the aid of silwet L-77," *Plant Physiology and Biochemistry* 48:703-709, 2010.

\* cited by examiner

COMPOSITIONS AND METHODS FOR CONTROLLING *DIABROTICA*

CROSS REFERENCE TO RELATED APPLICATIONS

This application is a divisional of U.S. application Ser. No. 14/207,313, filed Mar. 12, 2014, which application claims the benefit of U.S. Provisional Application No. 61/782,884, filed Mar. 14, 2013, which are herein incorporated by reference in their entirety. This application is also a continuation-in-part of U.S. application Ser. No. 15/130,684, filed Apr. 15, 2016, which is a continuation of U.S. application Ser. No. 13/783,125, filed Mar. 1, 2013 (now U.S. Pat. No. 9,340,797), which is a continuation of U.S. application Ser. No. 13/226,353, filed Sep. 6, 2011 (now U.S. Pat. No. 9,238,822), which is a continuation of U.S. application Ser. No. 11/547,764, filed Apr. 21, 2009 (now U.S. Pat. No. 8,946,510), which is a 35 U.S.C. 371 National Stage Entry of PCT/US2005/011816, filed Apr. 8, 2005 (published), which claims priority to United States Provisional Application Nos. 60/669,175, filed Apr. 7, 2005, 60/617,261, filed Oct. 11, 2004, 60/603,421, filed Aug. 20, 2004, 60/579,062, filed Jun. 11, 2004, 60/565,632, filed Apr. 27, 2004, and 60/560,842, filed Apr. 9, 2004, each of the contents of which are incorporated by reference in their entirety.

INCORPORATION OF SEQUENCE LISTINGS

The sequence listing that is contained in the file named "MONS355US.txt", which is 699 kilobytes (as measured in Microsoft Windows®) and was created on Mar. 11, 2014, is filed herewith by electronic submission and is incorporated by reference herein.

FIELD OF THE INVENTION

This invention discloses methods for controlling invertebrate pest infestations, particularly in plants, and compositions and polynucleotides useful in such methods. More specifically, this invention is related to polynucleotides and methods of use thereof for modifying the expression of genes in an invertebrate pest, particularly through RNA interference. Particular pest species of interest include *Diabrotica* species, especially those that infest crop plants.

BACKGROUND OF THE INVENTION

Commercial crops are often the targets of attack by invertebrate pests such as insects. Compositions for controlling insect infestations in plants have typically been in the form of chemical insecticides. However, there are several disadvantages to using chemical insecticides. For example, chemical insecticides are generally not selective, and applications of chemical insecticides intended to control insect pests in crop plants can exert their effects on non-target insects and other invertebrates as well. Chemical insecticides often persist in the environment and can be slow to degrade, thus potentially accumulating in the food chain. Furthermore the use of persistent chemical insecticides can result in the development of resistance in the target insect species. Thus there has been a long felt need for more environmentally friendly methods for controlling or eradicating insect infestation on or in plants, i. e., methods which are species-selective, environmentally inert, non-persistent, and biodegradable, and that fit well into pest resistance management schemes.

Insecticidal compositions that include *Bacillus thuringiensis* ("Bt") bacteria have been commercially available and used as environmentally safe and acceptable insecticides for more than thirty years. The effectiveness of these compositions is due to insecticidal proteins that are produced exclusively by Bt bacteria. The insecticidal Bt proteins do not persist in the environment, are highly selective as to the target species affected, exert their effects only upon ingestion by a target insect, and have been shown to be harmless to plants and other non-targeted organisms, including humans and other vertebrates. Transgenic plants containing one or more recombinant genes encoding insecticidal Bt proteins are also available in the art and are resistant to insect pest infestation. One positive environmental result of the use of transgenic plants expressing Bt proteins is a decrease in the amount of chemical insecticides that are applied to control pest infestation in such transgenic crop fields, resulting in decreased contamination of soil and waters by non-degraded or excess chemical insecticides. In addition, there has been a noticeable increase in the numbers of beneficial insects in fields in which Bt protein-expressing transgenic crop plants are grown because of the decrease in the use of non-selective chemical insecticides.

RNA interference (RNAi, RNA-mediated gene suppression) is another approach used for pest control. In invertebrates RNAi-based gene suppression was first demonstrated in nematodes (Fire et al., (1998) *Nature,* 391:806-811; Timmons & Fire (1998) *Nature,* 395:854). Subsequently, RNAi-based suppression of invertebrate genes using recombinant nucleic acid techniques has been reported in a number of species, including agriculturally or economically important pests from various insect and nematode taxa, such as: root-knot nematodes (*Meloidogyne* spp.), see Huang et al. (2006) *Proc. Natl. Acad. Sci. USA,* 103:14302-14306; cotton bollworm (*Helicoverpa armigera*), see Mao et al. (2007) *Nature Biotechnol.,* 25:1307-1313; Western corn rootworm (*Diabrotica virgifera virgifera* LeConte), see Baum et al. (2007) *Nature Biotechnol.,* 25:1322-1326; sugar beet cyst nematode (*Heterodera schachtii*), see Sindhu et al. (2008) *J. Exp. Botany,* 60:315-324; mosquito (*Aedes aegypti*), see Pridgeon et al. (2008) *J. Med. Entomol.,* 45:414-420; fruit flies (*Drosophila melanogaster*), flour beetles (*Tribolium castaneum*), pea aphids (*Acyrthosiphon pisum*), and tobacco hornworms (*Manduca sexta*), see Whyard et al. (2009) *Insect Biochem. Mol. Biol.,* 39:824-832; diamondback moth (*Plutella xylostella*), see Gong et al. (2011) *Pest Manag. Sci.,* 67: 514-520; green peach aphid (*Myzus persicae*), see Pitino et al. (2011) *PLoS ONE,* 6:e25709; brown planthopper (*Nilaparvata lugens*), see Li et al. (2011) *Pest Manag. Sci.,* 67:852-859; and whitefly (*Bemisia tabaci*), see Upadhyay et al. (2011) *J. Biosci.,* 36:153-161.

This invention is related to methods of controlling insect pests, in particular *Diabrotica* spp. which infest crop plants. This invention is further related to polynucleotides and recombinant DNA molecules and constructs useful in such methods. This invention is further related to insecticidal compositions, as well as to transgenic plants resistant to infestation by *Diabrotica* spp.

This invention is also related to methods of selecting target genes that are likely to represent essential functions, making these genes preferred targets for RNAi-mediated silencing.

SUMMARY OF THE INVENTION

This invention is related to control of *Diabrotica* species, especially those that are economically or agriculturally important pests. The compositions and methods of this invention include recombinant polynucleotide molecules, such as recombinant DNA constructs for making transgenic plants resistant to infestation by *Diabrotica* species and single- or double-stranded DNA or RNA "triggers" that are useful, e. g., as topically applied agents for causing RNAi-mediated suppression of a target gene in a *Diabrotica* species and thus controlling or preventing infestation by that *Diabrotica* species. A particular utility of this invention is providing maize plants, such as transgenic maize plants expressing a polynucleotide of this invention, or maize plants that have been topically treated with a polynucleotide of this invention, that are resistant to infestation by corn rootworm varieties of *Diabrotica* species. Another particular utility of this invention is a polynucleotide-containing composition that is topically applied to a *Diabrotica* species or to a plant to be protected from infestation by a *Diabrotica* species. This invention is further related to methods for selecting preferred *Diabrotica* target genes that are more likely to be effective targets for RNAi-mediated control of a *Diabrotica* species; examples of such preferred target genes are genes that are non-repetitive and non-redundant in a *Diabrotica* species genome, or that have low nucleotide diversity, or that are evolutionarily or functionally constrained to have a more synonymous ($K_s$) than nonsynonymous ($K_a$) nucleotide changes.

In one aspect, this invention provides a method for controlling a *Diabrotica* species infestation of a plant including contacting the *Diabrotica* species with a polynucleotide including at least 18 contiguous nucleotides with a sequence of about 95% to about 100% identity with a segment of equivalent length of a DNA having a sequence selected from the group consisting of SEQ ID NOs:1-450 or the DNA complement thereof.

In another aspect, this invention provides method for controlling a *Diabrotica* species infestation of a plant including providing in the diet of a *Diabrotica* species an agent including a polynucleotide having at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof, wherein the agent functions upon ingestion by the *Diabrotica* species to inhibit a biological function within the *Diabrotica* species thereby controlling infestation by the *Diabrotica* species.

In another aspect, this invention provides a method of causing mortality or stunting in *Diabrotica* species larvae including providing in the diet of *Diabrotica* species larvae at least one recombinant RNA including at least one silencing element essentially identical or essentially complementary to a target gene of the *Diabrotica* species larvae, wherein the target gene sequence is selected from the group consisting of SEQ ID NOs:1-450 or the complement thereof, and wherein ingestion of the recombinant RNA by the *Diabrotica* species larvae results in mortality or stunting in the *Diabrotica* species larvae.

In another aspect, this invention provides a method of providing a plant having improved resistance to a *Diabrotica* species infestation including topically applying to the plant a composition including at least one polynucleotide having at least one segment of 18 or more contiguous nucleotides with a sequence of about 95% to about 100% with a segment of equivalent length of a DNA having a sequence selected from the group consisting of SEQ ID NOs:1-450 or the DNA complement thereof.

In another aspect, this invention provides a composition for controlling a *Diabrotica* species including at least one recombinant polynucleotide including at least 18 contiguous nucleotides that are essentially identical or complementary to a segment of equivalent length of a DNA having a sequence selected from the group consisting of SEQ ID NOs:1-450.

In another aspect, this invention provides a method of providing a plant having improved resistance to a *Diabrotica* species infestation including expressing in the plant at least one polynucleotide including at least 18 contiguous nucleotides that are essentially identical or complementary to a segment of equivalent length of a DNA having a sequence selected from the group consisting of SEQ ID NOs:1-450.

In another aspect, this invention provides a recombinant DNA construct including a heterologous promoter operably linked to DNA including at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof.

In another aspect, this invention provides a transgenic maize plant cell having in its genome a recombinant DNA encoding RNA that suppresses expression of a target gene in a *Diabrotica* species that contacts or ingests the RNA, wherein the RNA includes at least one silencing element complementary to the target gene, and wherein the target gene sequence is selected from the group consisting of SEQ ID NOs:1-450 or the complement thereof.

In another aspect, this invention provides an isolated recombinant RNA molecule that causes mortality or stunting of growth in a *Diabrotica* species when ingested or contacted by the *Diabrotica* species, wherein the recombinant RNA molecule includes at least 18 contiguous nucleotides that are essentially complementary to a segment of equivalent length of a DNA having a sequence selected from the group consisting of SEQ ID NOs:1-450 or the DNA complement thereof.

In another aspect, this invention provides a method of providing a plant having improved resistance to a *Diabrotica* species infestation including providing to the plant at least one polynucleotide including at least 18 contiguous nucleotides that are essentially identical or complementary to a segment of equivalent length of a DNA of a target gene selected from the group consisting of the genes identified in Table 1.

In yet a further aspect, this invention provides a method for controlling a *Diabrotica* species infestation of a plant including contacting the *Diabrotica* species with a polynucleotide including at least 18 contiguous nucleotides that are essentially identical or complementary to a segment of equivalent length of a DNA of a target gene selected from the group consisting of the genes identified in Table 1.

In yet a further aspect, this invention provides a method of selecting preferred target genes for RNAi-mediated silencing from a plant genome or from an animal genome. In various embodiments, the method provides a subset of target genes that are present in single- or low-copy-number (i. e., non-repetitive and non-redundant) in a particular genome, or that have low nucleotide diversity, or that have a ratio of synonymous ($K_s$) to nonsynonymous ($K_a$) nucleotide changes where $K_s \gg K_a$.

In related aspects, this invention provides compositions including the polynucleotide of this invention, such as formulations useful for topical application to a plant or substance in need of protection from a *Diabrotica* species infestation, recombinant constructs and vectors useful for making transgenic plant cells and transgenic plants, formulations and coatings useful for treating seeds, seeds treated with or containing a polynucleotide of this invention as well as commodity products and foodstuffs produced from such seeds (especially commodity products and foodstuffs having a detectable amount of a polynucleotide of this invention). A further aspect of this invention are polyclonal or monoclonal antibodies that bind a protein encoded by a sequence or a fragment of a sequence selected from the group consisting of SEQ ID NOs:1-450; such antibodies are made by routine methods as known to one of ordinary skill in the art.

Other aspects and specific embodiments of this invention are disclosed in the following detailed description.

DETAILED DESCRIPTION OF THE INVENTION

Unless defined otherwise, all technical and scientific terms used have the same meaning as commonly understood by one of ordinary skill in the art to which this invention belongs. Generally, the nomenclature used and the manufacturing or laboratory procedures described below are well known and commonly employed in the art. Conventional methods are used for these procedures, such as those provided in the art and various general references. Where a term is provided in the singular, the inventors also contemplate aspects of the invention described by the plural of that term. Where there are discrepancies in terms and definitions used in references that are incorporated by reference, the terms used in this application shall have the definitions given. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" ($6^{th}$ edition, 2002, McGraw-Hill, New York), or the "Oxford Dictionary of Biology" ($6^{th}$ edition, 2008, Oxford University Press, Oxford and New York). The inventors do not intend to be limited to a mechanism or mode of action. Reference thereto is provided for illustrative purposes only.

Unless otherwise stated, nucleic acid sequences in the text of this specification are given, when read from left to right, in the 5' to 3' direction. One of skill in the art would be aware that a given DNA sequence can be understood to define a corresponding RNA sequence which is identical to the DNA sequence except for replacement of the thymine (T) nucleotides of the DNA with uracil (U) nucleotides. Thus, providing a specific DNA sequence is understood to define the exact RNA equivalent. A given first polynucleotide sequence, whether DNA or RNA, further defines the sequence of its exact complement (which can be DNA or RNA), i. e., a second polynucleotide that hybridizes perfectly to the first polynucleotide by forming Watson-Crick base-pairs. By "essentially identical" or "essentially complementary" to a target gene or a segment of a target gene is meant that a polynucleotide strand (or at least one strand of a double-stranded polynucleotide) is designed to hybridize (generally under physiological conditions such as those found in a living plant or animal cell) to a target gene or to a segment of a target gene or to the transcript of the target gene or the segment of a target gene; one of skill in the art would understand that such hybridization does not necessarily require 100% sequence identity or complementarity. A first nucleic acid sequence is "operably" connected or "linked" with a second nucleic acid sequence when the first nucleic acid sequence is placed in a functional relationship with the second nucleic acid sequence. For example, a promoter sequence is "operably linked" to DNA if the promoter provides for transcription or expression of the DNA. Generally, operably linked DNA sequences are contiguous.

The term "polynucleotide" commonly refers to a DNA or RNA molecule containing multiple nucleotides and generally refers both to "oligonucleotides" (a polynucleotide molecule of 18-25 nucleotides in length) and longer polynucleotides of 26 or more nucleotides. Polynucleotides also include molecules containing multiple nucleotides including non-canonical nucleotides or chemically modified nucleotides. Generally, polynucleotides of this invention, whether DNA or RNA or both, and whether single- or double-stranded, include at least 18 contiguous nucleotides (or, in the case of double-stranded polynucleotides, at least 18 contiguous base-pairs) that are essentially identical or complementary to a segment of equivalent size of the DNA of a target gene or the target gene's RNA transcript. Throughout this disclosure, "at least 18 contiguous" means "from about 18 to about 10,000, including every whole number point in between". Thus, embodiments of this invention include compositions including oligonucleotides having a length of 18-25 nucleotides (18-mers, 19-mers, 20-mers, 21-mers, 22-mers, 23-mers, 24-mers, or 25-mers), or medium-length polynucleotides having a length of 26 or more nucleotides (polynucleotides of 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), or long polynucleotides having a length greater than about 300 nucleotides (e. g., polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene). Where a polynucleotide is double-stranded, its length can be similarly described in terms of base pairs.

Controlling *Diabrotica* Infestations by Contacting with a Polynucleotide

A first aspect of this invention provides a method for controlling a *Diabrotica* species infestation of a plant including contacting the *Diabrotica* species with a polynucleotide including at least 18 contiguous nucleotides with a sequence of about 95% to about 100% identity with a segment of equivalent length of a DNA having a sequence selected from the group consisting of SEQ ID NOs:1-450 or the DNA complement thereof.

In various embodiments, the *Diabrotica* species is at least one selected from the group consisting of *Diabrotica balteata, Diabrotica barberi, Diabrotica beniensis, Diabrotica cristata, Diabrotica curvipustulata, Diabrotica dissimilis,*

*Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

The plant can be any plant that is subject to infestation by a *Diabrotica* species. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize.

The polynucleotide of this invention can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the polynucleotide is at least one selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used.

In some embodiments, the contiguous nucleotides have a sequence of about 95%, about 96%, about 97%, about 98%, about 99%, or about 100% identity with the segment of equivalent length of a DNA having a sequence selected from the group consisting of SEQ ID NOs:1-450 or the DNA complement thereof. In some embodiments the contiguous nucleotides are exactly (100%) identical to a segment of equivalent length of a DNA having a sequence selected from the group consisting of SEQ ID NOs:1-450 or the DNA complement thereof. In some embodiments, the polynucleotide has an overall sequence of about 95%, about 96%, about 97%, about 98%, about 99%, or about 100% identity with a segment of a DNA having a sequence selected from the group consisting of SEQ ID NOs:1-450 or the DNA complement thereof.

Polynucleotides of use in this method include at least 18 contiguous nucleotides with a sequence of about 95% to about 100% identity with a segment of equivalent length of a DNA having a sequence selected from the group consisting of SEQ ID NOs:1-450 or the DNA complement thereof. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The polynucleotide of this invention is generally designed to suppress one or more genes ("target genes"). The term "gene" refers to any portion of a nucleic acid that provides for expression of a transcript or encodes a transcript. A "gene" thus includes, but is not limited to, a promoter region, 5' untranslated regions, transcript encoding regions that can include intronic regions, and 3' untranslated regions. Thus, the target genes can include coding or non-coding sequence or both. In specific embodiments, the polynucleotide is designed to suppress one or more target genes, where each target gene has a DNA sequence selected from the group consisting of SEQ ID NOs:1-450. In various embodiments, the polynucleotide is designed to suppress one or more genes, where each gene has a sequence selected from the group consisting of SEQ ID NOs:1-450, and can be designed to suppress multiple genes from this group, or to target different regions of one or more of these genes. In an embodiment, the polynucleotide includes multiple sections or segments each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each section can be identical or different in size or in sequence, and can be sense or anti-sense relative to the target gene. For example, in one embodiment the polynucleotide can include multiple sections in tandem or repetitive arrangements, wherein each section includes at least 18 contiguous nucleotides with a sequence of about 95% to about 100% identity with a segment of equivalent length of a DNA having a sequence selected from the group consisting of SEQ ID NOs:1-450 or the DNA complement thereof; "spacer" nucleotides which do not correspond to a target gene can optionally be used in between the sections.

The total length of the polynucleotide of this invention can be greater than 18 contiguous nucleotides, and can include nucleotides in addition to the contiguous nucleotides having the sequence of about 95% to about 100% identity with a segment of equivalent length of a DNA having a sequence selected from the group consisting of SEQ ID NOs:1-450 or the DNA complement thereof. In other words, the total length of the polynucleotide can be greater than the length of the section or segment of the polynucleotide designed to suppress one or more target genes, where each target gene has a DNA sequence selected from the group consisting of SEQ ID NOs:1-450. For example, the polynucleotide can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the polynucleotide can include additional nucleotides that provide stabilizing secondary structure.

In various embodiments the polynucleotide of this invention consists of naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In certain embodiments, the polynucleotide includes non-canonical nucleotides such as inosine, thiouridine, or pseudouridine. In certain embodiments, the polynucleotide includes chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e. g., fluorescein or rhodamine) or other label (e. g., biotin).

The polynucleotide of this invention is provided by suitable means known to one in the art. Embodiments include those wherein the polynucleotide is chemically synthesized (e. g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments the polynucleotide of this invention is provided as an isolated DNA or RNA fragment (not part of an expression construct, i. e., lacking additional elements such as a promoter or terminator sequences). Such polynucleotides can be relatively short, such as single- or double-stranded polynucleotides of between about 18 to about 200 or about 300 nucleotides (for single-stranded polynucleotides) or between about 18 to about 200 or about 300 base-pairs (for double-stranded polynucleotides). Alternatively the polynucleotide can be provided in more complex constructs, e. g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e. g., an insecticidal protein).

In various embodiments of the method, the contacting includes application to a surface of the *Diabrotica* species of a suitable composition including the polynucleotide of this invention; such a composition can be provided, e. g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. The contacting can be in the form of a seed treatment. Suitable binders, inert carriers, surfactants, and the like can optionally be included in the composition, as is known to one skilled in formulation of pesticides and seed treatments. In embodiments, the contacting includes providing the polynucleotide in a composition that further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In embodiments, the contacting includes providing the polynucleotide in a composition that further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporus* insecticidal protein, and a *Bacillus sphearicus* insecticidal protein. In one embodiment the contacting includes providing the polynucleotide in a composition that can be ingested or otherwise absorbed internally by the *Diabrotica* species.

It is anticipated that the combination of certain polynucleotides of this invention (e. g., the polynucleotide triggers described in the working Examples) with one or more non-polynucleotide pesticidal agents will result in a synergetic improvement in prevention or control of *Diabrotica* species infestations, when compared to the effect obtained with the polynucleotide alone or the non-polynucleotide pesticidal agent alone. In an embodiment, a composition containing one or more polynucleotides of this invention and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporus* insecticidal protein, and a *Bacillus sphearicus* insecticidal protein, is found to effect synergistically improved prevention or control of *Diabrotica* species infestations.

Controlling *Diabrotica* Infestations by Providing a Dietary Polynucleotide

Another aspect of this invention provides a method for controlling a *Diabrotica* species infestation of a plant including providing in the diet of a *Diabrotica* species an agent including a polynucleotide having at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof, wherein the agent functions upon ingestion by the *Diabrotica* species to inhibit a biological function within the *Diabrotica* species thereby controlling infestation by the *Diabrotica* species.

In various embodiments, the *Diabrotica* species is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

In various embodiments, the agent including a polynucleotide of this invention includes a microbial cell or is produced in a microorganism. For example, the agent can include or can be produced in bacteria or yeast cells. In similar embodiments the agent including a polynucleotide includes a transgenic plant cell or is produced in a plant cell (for example a plant cell transiently expressing the polynucleotide); such plant cells can be cells in an plant or cells grown in tissue culture or in cell suspension.

The plant can be any plant that is subject to infestation by a *Diabrotica* species. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize.

In various embodiments, the agent including a polynucleotide of this invention is provided for dietary uptake by the *Diabrotica* species in a form suitable for ingestion, for example, as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. The agent including a polynucleotide can be provided for dietary uptake by the *Diabrotica* species by applying the agent to a plant subject to infestation by the *Diabrotica* species, for example by spraying, dusting, or coating the plant, or by application of a soil drench, or by providing in an artificial diet. The agent including a polynucleotide can be provided for dietary uptake by the *Diabrotica* species in an artificial diet formulated to meet the particular nutritional requirements for maintaining the *Diabrotica* species, wherein the artificial diet is supplemented with some amount of the polynucleotide obtained from a separate source such as chemical synthesis or purified from a microbial fermentation; this embodiment can be useful, e. g., for determining the timing and amounts of effective polynucleotide treatment regimes. In some embodiments the agent including a polynucleotide is provided for dietary uptake by the *Diabrotica* species in the form of a plant cell or in plant cell components, or in a microorganism (such as a bacterium or a yeast) or a microbial fermentation product, or in a synthetic diet. In one embodiment the agent including a polynucleotide is provided in the form of bait that is ingested by the *Diabrotica* species. The agent including a polynucleotide can be provided for dietary uptake by the *Diabrotica* species in the form of a seed treatment. Suitable binders, inert carriers, surfactants, and the like can be included in the agent, as is known to one skilled in formulation of pesticides and seed treatments. In embodiments, the agent including a polynucleotide further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In embodiments, the agent including a polynucleotide further includes at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

It is anticipated that the combination of certain polynucleotides of use in agents of this invention (e. g., the polynucleotide triggers described in the working Examples) with one or more non-polynucleotide pesticidal agents will result in a synergetic improvement in prevention or control of *Diabrotica* species infestations, when compared to the effect obtained with the polynucleotide alone or the non-polynucleotide pesticidal agent alone. In an embodiment, a composition containing one or more polynucleotides of this invention and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein, is found to effect synergistically improved prevention or control of *Diabrotica* species infestations when provided to the *Diabrotica* species in a diet.

The polynucleotide of use in agents of this invention can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the polynucleotide is at least one selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used.

In some embodiments, the contiguous nucleotides have a sequence of about 95%, about 96%, about 97%, about 98%, about 99%, or about 100% identity with the segment of equivalent length of a DNA having a sequence selected from the group consisting of SEQ ID NOs:1-450 or the DNA complement thereof. In some embodiments the contiguous nucleotides are exactly (100%) identical to a segment of equivalent length of a DNA having a sequence selected from the group consisting of SEQ ID NOs:1-450 or the DNA complement thereof. In some embodiments, the polynucleotide has an overall sequence of about 95%, about 96%, about 97%, about 98%, about 99%, or about 100% identity with a segment of a DNA having a sequence selected from the group consisting of SEQ ID NOs:1-450 or the DNA complement thereof.

Polynucleotides of use in agents of this invention include at least 18 contiguous nucleotides with a sequence of about 95% to about 100% identity with a segment of equivalent length of a DNA having a sequence selected from the group consisting of SEQ ID NOs:1-450 or the DNA complement thereof. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The polynucleotide of use in agents of this invention is generally designed to suppress one or more genes ("target genes"). The term "gene" refers to any portion of a nucleic acid that provides for expression of a transcript or encodes a transcript. A "gene" thus includes, but is not limited to, a promoter region, 5' untranslated regions, transcript encoding regions that can include intronic regions, and 3' untranslated regions. Thus, the target genes can include coding or non-coding sequence or both. In specific embodiments, the polynucleotide is designed to suppress one or more target genes, where each target gene has a DNA sequence selected from the group consisting of SEQ ID NOs:1-450. In various embodiments, the polynucleotide is designed to suppress one or more genes, where each gene has a sequence selected from the group consisting of SEQ ID NOs:1-450, and can be designed to suppress multiple genes from this group, or to target different regions of one or more of these genes. In an embodiment, the polynucleotide includes multiple sections or segments each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each section can be identical or different in size or in sequence, and can be sense or anti-sense relative to the target gene. For example, in one embodiment the polynucleotide can include multiple sections in tandem or repetitive arrangements, wherein each section includes at least 18 contiguous nucleotides with a sequence of about 95% to about 100% identity with a segment of equivalent length of a DNA having a sequence selected from the group consisting of SEQ ID NOs:1-450 or the DNA complement thereof; "spacer" nucleotides which do not correspond to a target gene can optionally be used in between the sections.

The total length of the polynucleotide of use in agents of this invention can be greater than 18 contiguous nucleotides, and can include nucleotides in addition to the contiguous nucleotides having the sequence of about 95% to about 100% identity with a segment of equivalent length of a DNA having a sequence selected from the group consisting of SEQ ID NOs:1-450 or the DNA complement thereof. In other words, the total length of the polynucleotide can be greater than the length of the section or segment of the polynucleotide designed to suppress one or more target genes, where each target gene has a DNA sequence selected from the group consisting of SEQ ID NOs:1-450. For example, the polynucleotide can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the polynucleotide can include additional nucleotides that provide stabilizing secondary structure.

In various embodiments the polynucleotide of use in agents of this invention consists of naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In certain embodiments, the polynucleotide includes non-canonical nucleotides such as inosine, thiouridine, or pseudouridine. In certain embodiments, the polynucleotide includes chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e.g., fluorescein or rhodamine) or other label (e.g., biotin).

The polynucleotide of use in agents of this invention is provided by suitable means known to one in the art. Embodiments include those wherein the polynucleotide is chemically synthesized (e.g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments the polynucleotide of use in agents of this invention is provided as an isolated DNA or RNA fragment (not part of an expression construct, i.e., lacking additional elements such as a promoter or terminator sequences). Such polynucleotides can be relatively short, such as single- or double-stranded polynucleotides of between about 18 to about 200 or about 300 nucleotides (for single-stranded polynucleotides) or between about 18 to about 200 or about 300 base-pairs (for double-stranded polynucleotides). Alternatively the polynucleotide can be provided in more complex constructs, e.g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e.g., an insecticidal protein). Controlling *Diabrotica* Infestations by Providing a Dietary Recombinant RNA Another aspect of this invention provides a method of causing mortality or stunting in *Diabrotica* species larvae including providing in the diet of *Diabrotica* species larvae at least one recombinant RNA including at least one silencing element, wherein the at least one silencing element is essentially identical or essentially complementary to a target gene of the *Diabrotica* species larvae, wherein the target gene sequence is selected from the group consisting of SEQ ID NOs:1-450 or the complement thereof, and wherein ingestion of the recombinant RNA by the *Diabrotica* species larvae results in mortality or stunting in the *Diabrotica* species larvae. A related aspect of this invention is the recombinant RNA including at least one silencing element, wherein the at least one silencing element is essentially identical or essentially complementary to a target gene of the *Diabrotica* species larvae, wherein the target gene sequence is selected from the group consisting of SEQ ID NOs:1-450 or the complement thereof.

In various embodiments, the *Diabrotica* species is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

In various embodiments, the diet providing the recombinant RNA includes a microbial cell or is produced in a microorganism. For example, the diet providing the recombinant RNA can include or can be produced in bacteria or yeast cells. In similar embodiments the diet providing the recombinant RNA includes a transgenic plant cell or is produced in a plant cell (for example a plant cell transiently expressing the polynucleotide); such plant cells can be cells in an plant or cells grown in tissue culture or in cell suspension.

In one embodiment the diet providing the recombinant RNA is any plant that is subject to infestation by a *Diabrotica* species, wherein the recombinant RNA is contained in or on the plant. Such plants can be stably transgenic plants that express the recombinant RNA, or non-transgenic plants that transiently express the recombinant RNA. Stably transgenic plants generally contain integrated into their genome a recombinant construct that encodes the recombinant RNA. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize.

In various embodiments, the diet providing the recombinant RNA is provided in a form suitable for ingestion by the *Diabrotica* species, for example, as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. The diet providing the recombinant RNA can be provided by applying the diet to a plant subject to infestation by the *Diabrotica* species, for example by spraying, dusting, or coating the plant, or by application of a soil drench, or by providing in an artificial diet. In one embodiment the diet providing the recombinant RNA is provided in the form of bait that is ingested by the *Diabrotica* species. The diet providing the recombinant RNA can be an artificial diet formulated to meet the particular nutritional requirements for maintaining the *Diabrotica* species, wherein the artificial diet is supplemented with some amount of the recombinant RNA obtained from a separate source such as chemical synthesis or purified from a microbial fermentation; this embodiment can be useful, e. g., for determining the timing and amounts of effective polynucleotide treatment regimes. In some embodiments the diet providing the recombinant RNA is provided in the form of a plant cell or in plant cell components, or in a microorganism (such as a bacterium or a yeast) or a microbial fermentation product, or in a synthetic diet. In one embodiment the diet providing the recombinant RNA is provided in the form of bait that is ingested by the *Diabrotica* species. The diet providing the recombinant RNA can be provided in the form of a seed treatment. Suitable binders, inert carriers, surfactants, and the like can be included in the diet, as is known to one skilled in formulation of pesticides and seed treatments. In embodiments, the diet providing the recombinant RNA further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In embodiments, the diet providing the recombinant RNA further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

It is anticipated that the combination of certain recombinant RNAs of this invention (e. g., the dsRNA triggers described in the working Examples) with one or more non-polynucleotide pesticidal agents will result in a synergetic improvement in prevention or control of *Diabrotica* species infestations, when compared to the effect obtained with the recombinant RNA alone or the non-polynucleotide pesticidal agent alone. In an embodiment, a composition containing one or more recombinant RNAs of this invention and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein, is found to effect synergistically improved prevention or control of *Diabrotica* species infestations.

The recombinant RNA of this invention can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the recombinant RNA is at least one selected from the group consisting of sense single-stranded RNA (ssRNA), anti-sense single-stranded (ssRNA), or double-stranded RNA (dsRNA); a mixture of recombinant RNAs of any of these types can be used. In one embodiment a double-stranded DNA/RNA hybrid can be used.

The at least one recombinant RNA of this invention includes at least one silencing element, wherein the silencing element is essentially identical (as the RNA equivalent) or essentially complementary to a target gene of the *Diabrotica* species larvae, wherein the target gene sequence is selected from the group consisting of SEQ ID NOs:1-450 or the complement thereof. In some embodiments, the silencing element has a sequence of about 95%, about 96%, about 97%, about 98%, about 99%, or about 100% identity with a segment of equivalent length of a DNA having a sequence selected from the group consisting of SEQ ID NOs:1-450 or the DNA complement thereof. In some embodiments the silencing element is exactly (100%) identical (as the RNA equivalent) to a segment of equivalent length of a DNA having a sequence selected from the group consisting of SEQ ID NOs:1-450 or the DNA complement thereof. In some embodiments, the silencing element has an overall sequence of about 95%, about 96%, about 97%, about 98%, about 99%, or about 100% identity with the segment of a DNA having a sequence selected from the group consisting of SEQ ID NOs:1-450 or the DNA complement thereof.

In some embodiments, the silencing element includes at least 18 contiguous nucleotides with a sequence of about 95% to about 100% with a segment of equivalent length of the target gene. In some embodiments the silencing element includes at least 18 contiguous nucleotides with a sequence of about 95% to about 100% identity with a segment of equivalent length of a DNA having a sequence selected from the group consisting of SEQ ID NOs:1-450 or the DNA complement thereof. In some embodiments the silencing element includes at least 18 contiguous nucleotides, e. g., between 18-24, or between 18-28, or between 20-30, or between 20-50, or between 20-100, or between 50-100, or between 100-250, or between 100-500, or between 200-1000 contiguous nucleotides. In some embodiments the silencing element includes more than 18 contiguous nucleotides, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300 contiguous nucleotides.

The recombinant RNA of this invention is generally designed to suppress one or more genes ("target genes"). Such target genes can include coding or non-coding sequence or both. In specific embodiments, the recombinant RNA is designed to suppress one or more target genes, where each target gene has a DNA sequence selected from the group consisting of SEQ ID NOs:1-450. In various embodiments, the recombinant RNA is designed to suppress one or more genes, where each gene has a sequence selected from the group consisting of SEQ ID NOs:1-450, and can be designed to suppress multiple genes from this group, or to target different regions of one or more of these genes. In an embodiment, the recombinant RNA includes multiple silencing elements each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each silencing element can be identical or different in size or in sequence, and can be sense or anti-sense relative to the target gene. For example, in one embodiment the polynucleotide can include multiple silencing elements in tandem or repetitive arrangements, wherein each silencing element includes at least 18 contiguous nucleotides with a sequence of about 95% to about 100% identity with a segment of equivalent length of a DNA having a sequence selected from the group consisting of SEQ ID NOs:1-450 or the DNA complement thereof; "spacer" nucleotides which do not correspond to a target gene can optionally be used in between the silencing elements.

The total length of the recombinant RNA of this invention can be greater than 18 contiguous nucleotides, and can include nucleotides in addition to the silencing element having the sequence of about 95% to about 100% identity with a segment of equivalent length of a DNA having a sequence selected from the group consisting of SEQ ID NOs:1-450 or the DNA complement thereof. In other words, the total length of the recombinant RNA can be greater than the length of the silencing element designed to suppress one or more target genes, where each target gene has a DNA sequence selected from the group consisting of SEQ ID NOs:1-450. For example, the recombinant RNA can have nucleotides flanking the "active" silencing element of at least 18 contiguous nucleotides that suppresses the target gene, or include "spacer" nucleotides between active silencing element, or can have additional nucleotides at the 5' end, or at the 3' end, or at both the 5' and 3' ends. In an embodiment, the recombinant RNA can include additional nucleotides that provide stabilizing secondary structure.

In various embodiments the recombinant RNA of this invention consists of naturally occurring ribonucleotides. In other embodiments the recombinant RNA is chemically modified, or includes chemically modified nucleotides. The recombinant RNA is provided by suitable means known to one in the art. Embodiments include those wherein the recombinant RNA is chemically synthesized (e. g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments the recombinant RNA of this invention is provided as an isolated RNA fragment. Such RNAs can be relatively short, such as single- or double-stranded RNAs of between about 18 to about 200 or about 300 nucleotides (for single-stranded RNAs) or between about 18 to about 200 or about 300 base-pairs (for double-stranded RNAs). Alternatively the recombinant RNA can be provided in more complex constructs, e. g., including additional RNA encoding an aptamer or ribozyme or an insecticidal protein.

Methods of Providing Plants Having Improved Resistance to *Diabrotica* Infestations, and the Plants and Seeds Thus Provided Another aspect of this invention provides a method of providing a plant having improved resistance to a *Diabrotica* species infestation including topically applying to the plant a composition including at least one polynucleotide having at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof, whereby the plant treated with the polynucleotide composition exhibits improved resistance to a *Diabrotica* species infestation, relative to an untreated plant. In an embodiment the at least one polynucleotide includes at least 18 contiguous nucleotides that are essentially identical or complementary to a segment of equivalent length of a DNA having a sequence selected from the group consisting of SEQ ID NOs:1-450.

The plant can be any plant that is subject to infestation by a *Diabrotica* species. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize.

In various embodiments, the *Diabrotica* species is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera,* and *Diabrotica viridula.* In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa.*

By "topical application" is meant application to the surface or exterior of an object, such as the surface or exterior of a plant, such as application to the surfaces of a plant part such as a leaf, stem, flower, fruit, shoot, root, seed, tuber, flowers, anthers, or pollen, or application to an entire plant, or to the above-ground or below-ground portions of a plant. Topical application can be carried out on non-living surfaces, such as application to soil, or to a surface or matrix by which a *Diabrotica* insect can come in contact with the polynucleotide. In various embodiments of the method, the composition including at least one polynucleotide is topically applied to the plant in a suitable form, e. g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. Topical application of the polynucleotide-containing composition to the plant can be in the form of a seed treatment. Suitable binders, inert carriers, surfactants, and the like can optionally be included in the composition, as is known to one skilled in formulation of pesticides and seed treatments. In one embodiment the polynucleotide-containing composition can be ingested or otherwise absorbed internally by the *Diabrotica* species. For example, the polynucleotide-containing composition can be in the form of bait. In embodiments, the polynucleotide-containing composition further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In one embodiment the composition further includes a nonionic organosilicone surfactant such as Silwet, e. g., Silwet® L-77 surfactant having CAS Number 27306-78-1 and EPA Number: CAL.REG.NO. 5905-50073-AA, currently available from Momentive Performance Materials, Albany, N.Y. In embodiments, the topically applied composition further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein. Alternatively such additional components or pesticidal agents can be provided separately, e. g., by separate topical application or by transgenic expression in the plant. Alternatively the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as Silwet, e. g., Silwet® L-77, followed by a second topical application of the polynucleotide-containing composition, or vice-versa.

It is anticipated that the combination of certain polynucleotides useful in compositions of this invention (e. g., the polynucleotide triggers described in the working Examples) with one or more non-polynucleotide pesticidal agents will result in a synergetic improvement in prevention or control of *Diabrotica* species infestations, when compared to the effect obtained with the polynucleotide alone or the non-polynucleotide pesticidal agent alone. In an embodiment, a transgenic plant expressing one or more polynucleotides of this invention and one or more genes encoding a non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein, is found to exhibit synergistically improved resistance to *Diabrotica* species infestations.

In some embodiments of the method, the composition including at least one polynucleotide is topically applied to above-ground parts of the plant, e. g., sprayed or dusted onto leaves, stems, and flowering parts of the plant. In other embodiments, the composition including at least one polynucleotide is topically applied to below-ground parts of the plant, such as to the roots, e. g., by means of a soil drench. In other embodiments, the composition including at least one polynucleotide is topically applied to a seed that is grown into the plant.

The polynucleotide useful in compositions of this invention can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the polynucleotide is at least one selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used.

In various embodiments the polynucleotide useful in compositions of this invention consists of naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In certain embodiments, the polynucleotide includes non-canonical nucleotides such as inosine, thiouridine, or pseudouridine. In certain embodiments, the polynucleotide includes chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e. g., fluorescein or rhodamine) or other label (e. g., biotin).

The polynucleotide useful in compositions of this invention is provided by suitable means known to one in the art. Embodiments include those wherein the polynucleotide is chemically synthesized (e. g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments the polynucleotide useful in compositions of this invention is provided as an isolated DNA or RNA fragment (not part of an expression construct, i. e., lacking additional elements such as a promoter or terminator sequences). Such polynucleotides can be relatively short, such as single- or double-stranded polynucleotides of between about 18 to about 200 or about 300 nucleotides (for single-stranded polynucleotides) or between about 18 to about 200 or about 300 base-pairs (for double-stranded polynucleotides). Alternatively the polynucleotide can be provided in more complex constructs, e. g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e. g., an insecticidal protein).

The polynucleotide useful in compositions of this invention (i. e., the polynucleotide of this invention that is topically applied to the plant) has at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. In an embodiment the polynucleotide that is topically applied to the plant includes at least 18 contiguous nucleotides that are essentially identical or complementary to a segment of equivalent length of a DNA having a sequence selected from the group consisting of SEQ ID NOs:1-450. In some embodiments, the contiguous nucleotides have a sequence of about 95%, about 96%, about 97%, about 98%, about 99%, or about 100% identity with the segment of equivalent length of a DNA having a sequence selected from the group consisting of SEQ ID NOs:1-450 or the DNA complement thereof. In some embodiments the contiguous nucleotides are exactly (100%) identical to a segment of equivalent length of a DNA having a sequence selected from the group consisting of SEQ ID NOs:1-450 or the DNA complement thereof. In some embodiments, the polynucleotide has an overall sequence of about 95%, about 96%, about 97%, about 98%, about 99%, or about 100% identity with a segment of a DNA having a sequence selected from the group consisting of SEQ ID NOs:1-450 or the DNA complement thereof.

The polynucleotide useful in compositions of this invention (i. e., the polynucleotide of this invention that is topically applied to the plant) includes at least 18 contiguous nucleotides with a sequence of about 95% to about 100% identity with a segment of equivalent length of a DNA having a sequence selected from the group consisting of SEQ ID NOs:1-450 or the DNA complement thereof. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The topically applied polynucleotide is generally designed to suppress one or more genes ("target genes"). Such target genes can include coding or non-coding sequence or both. In specific embodiments, the polynucleotide is designed to suppress one or more target genes, where each target gene has a DNA sequence selected from the group consisting of SEQ ID NOs:1-450. In various embodiments, the topically applied polynucleotide is designed to suppress one or more genes, where each gene has a sequence selected from the group consisting of SEQ ID NOs:1-450, and can be designed to suppress multiple genes from this group, or to target different regions of one or more of these genes. In an embodiment, the topically applied polynucleotide includes multiple sections or segments each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each section can be identical or different in size or in sequence, and can be sense or anti-sense relative to the target gene. For example, in one embodiment the topically applied polynucleotide can include multiple sections in tandem or repetitive arrangements, wherein each section includes at least 18 contiguous nucleotides with a sequence of about 95% to about 100% identity with a segment of equivalent length of a DNA having a sequence selected from the group consisting of SEQ ID NOs:1-450 or the DNA complement thereof; "spacer" nucleotides which do not correspond to a target gene can optionally be used in between the sections.

The total length of the topically applied polynucleotide can be greater than 18 contiguous nucleotides, and can include nucleotides in addition to the contiguous nucleotides having the sequence of about 95% to about 100% identity with a segment of equivalent length of a DNA having a sequence selected from the group consisting of SEQ ID NOs:1-450 or the DNA complement thereof. In other words, the total length of the topically applied polynucleotide can be greater than the length of the section or segment of the polynucleotide designed to suppress one or more target genes, where each target gene has a DNA sequence selected from the group consisting of SEQ ID NOs:1-450. For example, the topically applied polynucleotide can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the topically applied polynucleotide can include additional nucleotides that provide stabilizing secondary structure.

In a related aspect, this invention is directed to the plant having improved resistance to a *Diabrotica* species infestation, provided by this method which includes topically applying to the plant a composition including at least one polynucleotide having at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof, whereby the plant treated with the polynucleotide composition exhibits improved resistance to a *Diabrotica* species infestation, relative to an untreated plant. In yet another aspect, this invention is directed to seed (especially transgenic progeny seed) produced by the plant having improved resistance to a *Diabrotica* species infestation, as provided by this method. Also contemplated is a commodity product produced by the plant having improved resistance to a *Diabrotica* species infestation, as provided by this method, and a commodity product produced from the transgenic progeny seed of such a plant.

Compositions for Controlling *Diabrotica* Species

Another aspect of this invention provides a composition for controlling a *Diabrotica* species including at least one recombinant polynucleotide including at least 18 contiguous nucleotides that are essentially identical or complementary to a segment of equivalent length of a DNA having a sequence selected from the group consisting of SEQ ID NOs:1-450. In an embodiment the recombinant polynucleotide has at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. In this context "controlling" includes inducement of a physiological or behavioural change such as, but not limited to, growth stunting, increased mortality, decrease in reproductive capacity, decrease in or cessation of feeding behavior or movement, or decrease in or cessation of metamorphosis stage development.

In various embodiments, the composition for controlling a *Diabrotica* species is in the form of at least one selected from the group consisting of a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. Suitable binders, inert carriers, surfactants, and the like can be included in the composition for controlling a *Diabrotica* species, as is known to one skilled in formulation of pesticides and seed treatments. In embodiments, the composition for controlling a *Diabrotica* species further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In one embodiment the composition for controlling a *Diabrotica* species further includes a nonionic organosilicone surfactant such as Silwet, e. g., Silwet® L-77 surfactant having CAS Number 27306-78-1 and EPA Number: CAL.REG.NO. 5905-50073-AA, currently available from Momentive Performance Materials, Albany, N.Y. In embodiments, the composition for controlling a *Diabrotica* species further includes at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

It is anticipated that the combination of certain recombinant polynucleotides of this invention (e. g., the polynucleotide triggers described in the working Examples) with one or more non-polynucleotide pesticidal agents will result in a synergetic improvement in prevention or control of *Diabrotica* species infestations, when compared to the effect obtained with the recombinant polynucleotide alone or the non-polynucleotide pesticidal agent alone. In an embodiment, a composition containing one or more recombinant polynucleotides of this invention and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein, is found to effect synergistically improved prevention or control of *Diabrotica* species infestations.

The composition for controlling a *Diabrotica* species can be provided for dietary uptake by the *Diabrotica* species by applying the composition to a plant or surface subject to infestation by the *Diabrotica* species, for example by spraying, dusting, or coating the plant, or by application of a soil drench, or by providing in an artificial diet. The composition for controlling a *Diabrotica* species can be provided for dietary uptake by the *Diabrotica* species in an artificial diet formulated to meet the particular nutritional requirements for maintaining the *Diabrotica* species, wherein the artificial diet is supplemented with some amount of the recombinant polynucleotide obtained from a separate source such as chemical synthesis or purified from a microbial fermentation; this embodiment can be useful, e. g., for determining the timing and amounts of effective polynucleotide treatment regimes. In some embodiments the composition for controlling a *Diabrotica* species is provided for dietary uptake by the *Diabrotica* species in the form of a plant cell or in plant cell components, or in a microorganism (such as a bacterium or a yeast) or a microbial fermentation product, or in a synthetic diet. In one embodiment the composition for controlling a *Diabrotica* species is provided in the form of bait that is ingested by the *Diabrotica* species. The composition for controlling a *Diabrotica* species can be provided for dietary uptake by the *Diabrotica* species in the form of a seed treatment.

In various embodiments, the composition for controlling a *Diabrotica* species includes a microbial cell or is produced in a microorganism. For example, the composition for controlling a *Diabrotica* species can include or can be produced in bacteria or yeast cells. In similar embodiments the composition for controlling a *Diabrotica* species includes a transgenic plant cell or is produced in a plant cell (for example a plant cell transiently expressing the polynucleotide); such plant cells can be cells in an plant or cells grown in tissue culture or in cell suspension.

In various embodiments, the *Diabrotica* species to be controlled is at least one selected from the group consisting of *Diabrotica balteata*, *Diabrotica barberi*, *Diabrotica beniensis*, *Diabrotica cristata*, *Diabrotica curvipustulata*, *Diabrotica dissimilis*, *Diabrotica elegantula*, *Diabrotica emorsitans*, *Diabrotica graminea*, *Diabrotica hispanolae*, *Diabrotica lemniscata*, *Diabrotica linsleyi*, *Diabrotica longicornis*, *Diabrotica milleri*, *Diabrotica nummularis*, *Diabrotica occlusa*, *Diabrotica porracea*, *Diabrotica scutellata*, *Diabrotica speciosa*, *Diabrotica tibialis*, *Diabrotica trifasciata*, *Diabrotica undecimpunctata*, *Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

In some embodiments the *Diabrotica* species to be controlled infests a plant. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize.

The recombinant polynucleotide useful in compositions of this invention can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the recombinant polynucleotide is at least one selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used.

The recombinant polynucleotide of the composition for controlling a *Diabrotica* species includes at least 18 contiguous nucleotides that are essentially identical or complementary to a segment of equivalent length of a DNA having a sequence selected from the group consisting of SEQ ID NOs:1-450. In an embodiment the recombinant polynucleotide has at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. In some embodiments, the contiguous nucleotides have a sequence of about 95%, about 96%, about 97%, about 98%, about 99%, or about 100% identity with the segment of equivalent length of a DNA having a sequence selected from the group consisting of SEQ ID NOs:1-450 or the DNA complement thereof. In some embodiments the contiguous nucleotides are exactly (100%) identical to a segment of equivalent length of a DNA having a sequence selected from the group consisting of SEQ ID NOs:1-450 or the DNA complement thereof. In some embodiments, the polynucleotide has an overall sequence of about 95%, about 96%, about 97%, about 98%, about 99%, or about 100% identity with a segment of a DNA having a sequence selected from the group consisting of SEQ ID NOs:1-450 or the DNA complement thereof.

Recombinant polynucleotides of use in the composition for controlling a *Diabrotica* species include at least 18 contiguous nucleotides with a sequence of about 95% to about 100% identity with a segment of equivalent length of a DNA having a sequence selected from the group consisting of SEQ ID NOs:1-450 or the DNA complement thereof. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The recombinant polynucleotide is generally designed to suppress one or more genes ("target genes"). The term "gene" refers to any portion of a nucleic acid that provides for expression of a transcript or encodes a transcript. A "gene" thus includes, but is not limited to, a promoter region, 5' untranslated regions, transcript encoding regions that can include intronic regions, and 3' untranslated regions. Thus, the target genes can include coding or non-coding sequence or both. In specific embodiments, the polynucleotide is designed to suppress one or more target genes, where each target gene has a DNA sequence selected from the group consisting of SEQ ID NOs:1-450. In various embodiments, the polynucleotide is designed to suppress one or more genes, where each gene has a sequence selected from the group consisting of SEQ ID NOs:1-450, and can be designed to suppress multiple genes from this group, or to target different regions of one or more of these genes. In an embodiment, the polynucleotide includes multiple sections or segments each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each section can be identical or different in size or in sequence, and can be sense or anti-sense relative to the target gene. For example, in one embodiment the polynucleotide can include multiple sections in tandem or repetitive arrangements, wherein each section includes at least 18 contiguous nucleotides with a sequence of about 95% to about 100% identity with a segment of equivalent length of a DNA having a sequence selected from the group consisting of SEQ ID NOs:1-450 or the DNA complement thereof; "spacer" nucleotides which do not correspond to a target gene can optionally be used in between the sections.

The total length of the recombinant polynucleotide useful in compositions of this invention can be greater than 18 contiguous nucleotides, and can include nucleotides in addition to the contiguous nucleotides having the sequence of about 95% to about 100% identity with a segment of equivalent length of a DNA having a sequence selected from the group consisting of SEQ ID NOs:1-450 or the DNA complement thereof. In other words, the total length of the polynucleotide can be greater than the length of the section or segment of the polynucleotide designed to suppress one or more target genes, where each target gene has a DNA sequence selected from the group consisting of SEQ ID NOs:1-450. For example, the polynucleotide can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the polynucleotide can include additional nucleotides that provide stabilizing secondary structure.

In various embodiments the recombinant polynucleotide useful in compositions of this invention consists of naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In certain embodiments, the polynucleotide includes non-canonical nucleotides such as inosine, thiouridine, or pseudouridine. In certain embodiments, the polynucleotide includes chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e. g., fluorescein or rhodamine) or other label (e. g., biotin).

The recombinant polynucleotide useful in compositions of this invention is provided by suitable means known to one in the art. Embodiments include those wherein the polynucleotide is chemically synthesized (e. g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments the recombinant polynucleotide is provided as an isolated DNA or RNA fragment (not part of an expression construct, i. e., lacking additional elements such as a promoter or terminator sequences). Such polynucleotides can be relatively short, such as single- or double-stranded polynucleotides of between about 18 to about 200 or about 300 nucleotides (for single-stranded polynucleotides) or between about 18 to about 200 or about 300 base-pairs (for double-stranded polynucleotides). Alternatively the polynucleotide can be provided in more complex constructs, e. g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e. g., an insecticidal protein).

Methods of Providing Plants Having Improved Resistance to *Diabrotica* Species Infestations, and the Plants and Seeds Thus Provided Another aspect of this invention provides a method of providing a plant having improved resistance to a *Diabrotica* species infestation including expressing in the plant at least one polynucleotide including at least 18 contiguous nucleotides that are essentially identical or complementary to a segment of equivalent length of a DNA having a sequence selected from the group consisting of SEQ ID NOs:1-450, whereby the resulting plant has improved resistance to a *Diabrotica* species when compared to a control plant in which the polynucleotide is not expressed. In an embodiment the method includes expressing in the plant at least one polynucleotide including at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. By "expressing a polynucleotide in the plant" is generally meant "expressing an RNA transcript in the plant". However, the polynucleotide expressed in the plant can also be DNA, e. g., a DNA produced in the plant during genome replication.

The plant can be any plant that is subject to infestation by a *Diabrotica* species. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize.

In various embodiments, the *Diabrotica* species is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera,* and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

The method includes expressing at least one polynucleotide in a plant. In many embodiments, a first polynucleotide can be provided to a plant in the form of DNA (e. g., in the form of an isolated DNA molecule, or as an expression construct, or as a transformation vector), and the polynucleotide expressed in the plant is a second polynucleotide (an RNA transcript) in the plant. In an embodiment, the polynucleotide is expressed in the plant by transgenic expression, i. e., by stably integrating the polynucleotide into the plant's genome from where it can be expressed in a cell or cells of the plant. In an embodiment, a first polynucleotide (e. g., a recombinant DNA construct including a promoter operably linked to DNA encoding an RNA silencing element for suppressing a target gene selected from the group consisting of the genes identified in Table 1) is stably integrated into the plant's genome from where secondarily produced polynucleotides (e. g., an RNA transcript including the RNA silencing element for suppressing the target gene) can be expressed in a cell or cells of the plant. Methods of providing stably transformed plant are provided in the section headed "Making and Using Transgenic Plant Cells and Transgenic Plants".

In another embodiment the polynucleotide of use in methods of this invention is expressed by transient expression. In such embodiments the method can include a step of introducing a polynucleotide into the plant by routine techniques known in the art. For example, transient expression can be accomplished by infiltration of a polynucleotide solution using a needle-less syringe into a leaf of a plant.

In some embodiments where the polynucleotide of use in methods of this invention is expressed by transient expression, a first polynucleotide is provided to a plant in the form of RNA or DNA or both RNA and DNA, and a secondarily produced second polynucleotide is transiently expressed in the plant. In embodiments, the first polynucleotide is one or more selected from: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, and (i) a double-stranded, hybridized RNA/DNA molecule, or combinations thereof. In embodiments, a first polynucleotide is introduced into the plant by topical application to the plant of a polynucleotide-containing composition in a suitable form, e. g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. Topical application of the polynucleotide-containing composition to the plant can be in the form of a seed treatment. Suitable binders, inert carriers, surfactants, and the like can optionally be included in the composition, as is known to one skilled in formulation of pesticides and seed treatments. In embodiments, the polynucleotide-containing composition further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In one embodiment the composition further includes a nonionic organosilicone surfactant such as Silwet, e. g., Silwet® L-77 surfactant having CAS Number 27306-78-1 and EPA Number: CAL.REG.NO. 5905-50073-AA, currently available from Momentive Performance Materials, Albany, N.Y. In embodiments, the topically applied composition further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein. Alternatively such additional components or pesticidal agents can be provided separately, e. g., by separate topical application or by transgenic expression in the plant. Alternatively the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as Silwet, e. g., Silwet® L-77, followed by a second topical application of the polynucleotide-containing composition, or vice-versa.

It is anticipated that the combination of certain polynucleotides of this invention (e. g., the polynucleotide triggers described in the working Examples) with one or more non-polynucleotide pesticidal agents will result in a synergetic improvement in prevention or control of *Diabrotica* species infestations, when compared to the effect obtained with the polynucleotide alone or the non-polynucleotide pesticidal agent alone. In an embodiment, a transgenic plant expressing one or more polynucleotides of this invention and one or more genes encoding a non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein, is found to exhibit synergistically improved resistance to *Diabrotica* species infestations.

In embodiments where the polynucleotide of use in methods of this invention is expressed by transient expression, a first polynucleotide is provided to a plant in the form of RNA or DNA or both RNA and DNA, and a secondarily produced second polynucleotide is transiently expressed in the plant; the site of application of the first polynucleotide need not be the same site where the second polynucleotide is transiently expressed. For example, a first polynucleotide can be provided to a plant by topical application onto a leaf, or by injection into a stem, and the second polynucleotide can be transiently expressed elsewhere in the plant, e. g., in the roots or throughout the plant. In some embodiments of the method, a composition including at least one polynucleotide is topically applied to above-ground parts of the plant, e. g., sprayed or dusted onto leaves, stems, and flowering parts of the plant. In other embodiments, a composition including at least one polynucleotide is topically applied to below-ground parts of the plant, such as to the roots, e. g., by means of a soil drench. In other embodiments, a composition including at least one polynucleotide is topically applied to a seed that is grown into the plant having improved resistance to a *Diabrotica* species infestation.

The polynucleotide of use in methods of this invention can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the polynucleotide is at least one selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used.

In some embodiments a first polynucleotide (DNA or RNA or both) is provided to a plant and a second polynucleotide having a sequence corresponding to the first polynucleotide is subsequently expressed in the plant. In such embodiments the polynucleotide expressed in the plant is an RNA transcript which can be ssRNA or dsRNA or both. In some embodiments where the polynucleotide is expressed by transient expression, a first polynucleotide is provided to a plant in the form of RNA or DNA or both RNA and DNA, and a secondarily produced second polynucleotide is transiently expressed in the plant. In embodiments, the first polynucleotide may be one or more of the following: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, and (i) a double-stranded, hybridized RNA/DNA molecule, or combinations thereof. In various embodiments the first polynucleotide consists of naturally occurring nucleotides, such as those which occur in DNA and RNA. In other embodiments the first polynucleotide is chemically modified, or includes chemically modified nucleotides. The first polynucleotide is provided by suitable means known to one in the art. Embodiments include those wherein the first polynucleotide is chemically synthesized (e. g., by in vitro transcription, such as transcription using a T7 polymerase or other polymerase), produced by expression in a microorganism or in cell culture (such as plant or insect cells grown in culture), produced by expression in a plant cell, or produced by microbial fermentation. The first polynucleotide can be provided as an RNA or DNA fragment. Alternatively the first polynucleotide can be provided in more complex constructs, e. g., as part of a recombinant expression construct, or included in a recombinant vector, for example in a recombinant plant virus vector or in a recombinant baculovirus vector; such recombinant expression constructs or vectors can be designed to include additional elements, such as expression cassettes for expressing a gene of interest (e. g., an insecticidal protein).

In many embodiments the polynucleotide expressed in the plant is an isolated RNA fragment and can be relatively short, such as single- or double-stranded RNAs of between about 18 to about 200 or about 300 nucleotides (for single-stranded RNAs) or between about 18 to about 200 or about 300 base-pairs (for double-stranded RNAs).

The polynucleotide expressed in the plant has at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. In an embodiment the polynucleotide expressed in the plant includes at least 18 contiguous nucleotides that are essentially identical or complementary to a segment of equivalent length of a DNA having a sequence selected from the group consisting of SEQ ID NOs:1-450. In some embodiments, the contiguous nucleotides have a sequence of about 95%, about 96%, about 97%, about 98%, about 99%, or about 100% identity with the segment of equivalent length of a DNA having a sequence selected from the group consisting of SEQ ID NOs:1-450 or the DNA complement thereof. In some embodiments the contiguous nucleotides are exactly (100%) identical to a segment of equivalent length of a DNA having a sequence selected from the group consisting of SEQ ID NOs:1-450 or the DNA complement thereof. In some embodiments, the polynucleotide has an overall sequence of about 95%, about 96%, about 97%, about 98%, about 99%, or about 100% identity with a segment of a DNA having a sequence selected from the group consisting of SEQ ID NOs:1-450 or the DNA complement thereof.

The polynucleotide expressed in the plant includes at least 18 contiguous nucleotides with a sequence of about 95% to about 100% identity with a segment of equivalent length of a DNA having a sequence selected from the group consisting of SEQ ID NOs:1-450 or the DNA complement thereof. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The polynucleotide expressed in the plant is generally designed to suppress one or more genes ("target genes"). Such target genes can include coding or non-coding sequence or both. In specific embodiments, the polynucleotide expressed in the plant is designed to suppress one or more target genes, where each target gene has a DNA sequence selected from the group consisting of SEQ ID NOs:1-450. In various embodiments, the polynucleotide expressed in the plant is designed to suppress one or more genes, where each gene has a sequence selected from the group consisting of SEQ ID NOs:1-450, and can be designed to suppress multiple genes from this group, or to target different regions of one or more of these genes. In an embodiment, the polynucleotide expressed in the plant includes multiple sections or segments each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each section can be identical or different in size or in sequence, and can be sense or anti-sense relative to the target gene. For example, in one embodiment the polynucleotide expressed in the plant can include multiple sections in tandem or repetitive arrangements, wherein each section includes at least 18 contiguous nucleotides with a sequence of about 95% to about 100% identity with a segment of equivalent length of a DNA having a sequence selected from the group consisting of SEQ ID NOs:1-450 or the DNA complement thereof;

"spacer" nucleotides which do not correspond to a target gene can optionally be used in between the sections.

The total length of the polynucleotide expressed in the plant can be greater than 18 contiguous nucleotides, and can include nucleotides in addition to the contiguous nucleotides having the sequence of about 95% to about 100% identity with a segment of equivalent length of a DNA having a sequence selected from the group consisting of SEQ ID NOs:1-450 or the DNA complement thereof. In other words, the total length of the polynucleotide expressed in the plant can be greater than the length of the section or segment of the polynucleotide designed to suppress one or more target genes, where each target gene has a DNA sequence selected from the group consisting of SEQ ID NOs:1-450. For example, the polynucleotide expressed in the plant can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the polynucleotide expressed in the plant can include additional nucleotides that provide stabilizing secondary structure.

In a related aspect, this invention is directed to the plant having improved resistance to a *Diabrotica* species infestation, provided by expressing in the plant at least one polynucleotide including at least 18 contiguous nucleotides that are essentially identical or complementary to a segment of equivalent length of a DNA having a sequence selected from the group consisting of SEQ ID NOs:1-450, whereby the resulting plant has improved resistance to a *Diabrotica* species infestation when compared to a control plant in which the polynucleotide is not expressed. In a related aspect, this invention is directed to the plant having improved resistance to a *Diabrotica* species infestation, provided by expressing in the plant at least one polynucleotide including at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof, whereby the resulting plant has improved resistance to a *Diabrotica* species infestation when compared to a control plant in which the polynucleotide is not expressed. In yet another aspect, this invention is directed to seed (especially transgenic progeny seed) produced by the plant having improved resistance to a *Diabrotica* species infestation, as provided by this method. Also contemplated is a commodity product produced by the plant having improved resistance to a *Diabrotica* species infestation, as provided by this method, and a commodity product produced from the transgenic progeny seed of such a plant.

Recombinant DNA Constructs for Controlling a *Diabrotica* Species

Another aspect of this invention provides a recombinant DNA construct including a heterologous promoter operably linked to DNA including at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. The recombinant DNA constructs are useful in providing a plant having improved resistance to a *Diabrotica* species infestation, e. g., by expressing in a plant a transcript of such a recombinant DNA construct. The recombinant DNA constructs are also useful in the manufacture of polynucleotides useful in making compositions that can be applied to a plant or surface in need of protection from a *Diabrotica* species infestation.

The recombinant DNA construct of this invention includes a heterologous promoter operably linked to DNA including at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. In some embodiments, the segment of 18 or more contiguous nucleotides has a sequence with about 95%, about 96%, about 97%, about 98%, about 99%, or about 100% identity with the segment of equivalent length of a DNA having a sequence selected from the group consisting of SEQ ID NOs:1-450 or the DNA complement thereof. In some embodiments the contiguous nucleotides are exactly (100%) identical to a segment of equivalent length of a DNA having a sequence selected from the group consisting of SEQ ID NOs:1-450 or the DNA complement thereof. In some embodiments, the DNA has an overall sequence of about 95%, about 96%, about 97%, about 98%, about 99%, or about 100% identity with a DNA having a sequence selected from the group consisting of SEQ ID NOs:1-450 or the DNA complement thereof.

The recombinant DNA construct of this invention therefore includes a heterologous promoter operably linked to DNA including at least one segment of 18 or more contiguous nucleotides designed to suppress expression of a target gene having a sequence selected from the group consisting of SEQ ID NOs:1-450 or the DNA complement thereof. The contiguous nucleotides of the segment number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The recombinant DNA construct of this invention includes a heterologous promoter operably linked to DNA generally designed to suppress one or more genes ("target genes"). Such target genes can include coding or non-coding sequence or both. In specific embodiments, the recombinant DNA construct is designed to suppress one or more target genes, where each target gene has a DNA sequence selected from the group consisting of SEQ ID NOs:1-450. In various embodiments, the recombinant DNA construct is designed to suppress one or more genes, where each gene has a sequence selected from the group consisting of SEQ ID NOs:1-450, and can be designed to suppress multiple genes from this group, or to target different regions of one or more of these genes. In an embodiment, the recombinant DNA construct includes a heterologous promoter operably linked to multiple sections or segments each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each section can be identical or different in size or in sequence, and can be sense or antisense relative to the target gene. For example, in one embodiment the recombinant DNA construct can include a heterologous promoter operably linked to multiple sections in tandem or repetitive arrangements, wherein each section includes at least 18 contiguous nucleotides with a sequence of about 95% to about 100% identity with a segment of equivalent length of a DNA having a sequence selected from the group consisting of SEQ ID NOs:1-450 or the DNA complement thereof; "spacer" nucleotides which do not correspond to a target gene can optionally be used in between the sections.

The recombinant DNA construct of this invention includes a heterologous promoter operably linked to DNA which can have a total length that is greater than 18 contiguous nucleotides, and can include nucleotides in addition to the segment of at least 18 contiguous nucleotides having the sequence of about 95% to about 100% identity with a segment of equivalent length of a DNA having a sequence selected from the group consisting of SEQ ID NOs:1-450 or the DNA complement thereof. In other words, the total length of the DNA can be greater than the length of the segment of the DNA designed to suppress one or more target genes, where each target gene has a DNA sequence selected from the group consisting of SEQ ID NOs:1-450. For example, the DNA can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the DNA can include or encode additional nucleotides that provide stabilizing secondary structure.

In recombinant DNA constructs of this invention, the heterologous promoter is operably linked to DNA that encodes a transcript that can be single-stranded (ss) or double-stranded (ds) or a combination of both. Embodiments of the method include those wherein the DNA encodes a transcript including sense single-stranded RNA (ssRNA), anti-sense ssRNA, or double-stranded RNA (dsRNA), or a combination of any of these.

The recombinant DNA construct of this invention is provided by suitable means known to one in the art. Embodiments include those wherein the recombinant DNA construct is synthesized in vitro, produced by expression in a microorganism or in cell culture (such as plant or insect cells grown in culture), produced by expression in a plant cell, or produced by microbial fermentation.

The heterologous promoter of use in recombinant DNA constructs of this invention is selected from the group consisting of a promoter functional in a plant, a promoter functional in a prokaryote, a promoter functional in a fungal cell, and a baculovirus promoter. Non-limiting examples of promoters are described in the section headed "Promoters".

In some embodiments, the recombinant DNA construct of this invention includes a second promoter also operably linked to the DNA. For example, the DNA including at least one segment of 18 or more contiguous nucleotides can be flanked by two promoters arranged so that the promoters transcribe in opposite directions and in a convergent manner, yielding opposite-strand transcripts of the DNA that are complementary to and capable of hybridizing with each other to form double-stranded RNA. In one embodiment, the DNA is located between two root-specific promoters, which enable transcription of the DNA in opposite directions, resulting in the formation of dsRNA.

In some embodiments the recombinant DNA construct of this invention includes other DNA elements in addition to the heterologous promoter operably linked to DNA including at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. Such DNA elements are known in the art, and include but are not limited to introns, recombinase recognition sites, aptamers or ribozymes, additional and additional expression cassettes for expressing coding sequences (e. g., to express a transgene such as an insecticidal protein or selectable marker) or non-coding sequences (e. g., to express additional suppression elements). Inclusion of one or more recognition sites for binding and cleavage by a small RNA (e. g., by a miRNA or an siRNA that is expressed only in a particular cell or tissue) allows for more precise expression patterns in a plant, wherein the expression of the recombinant DNA construct is suppressed where the small RNA is expressed.

In some embodiments, the recombinant DNA construct of this invention is provided in a recombinant vector. By "recombinant vector" is meant a recombinant polynucleotide molecule that is used to transfer genetic information from one cell to another. Embodiments suitable to this invention include, but are not limited to, recombinant plasmids, recombinant cosmids, artificial chromosomes, and recombinant viral vectors such as recombinant plant virus vectors and recombinant baculovirus vectors.

In some embodiments, the recombinant DNA construct of this invention is provided in a plant chromosome or plastid, e. g., in a transgenic plant cell or a transgenic plant. Thus, also encompassed by this invention is a transgenic plant cell having in its genome the recombinant DNA construct, as well as a transgenic plant or partially transgenic plant including such a transgenic plant cell. Partially transgenic plants include, e. g., a non-transgenic scion grafted onto a transgenic rootstock including the transgenic plant cell. In various embodiments the plant is a row crop plant or a vegetable crop plant. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize. In yet another aspect, this invention is directed to seed (especially transgenic progeny seed) produced by the transgenic plant having in its genome a recombinant DNA construct of this invention. Also contemplated is a commodity product produced by such a transgenic plant, and a commodity product produced from the transgenic progeny seed of such a transgenic plant.

The recombinant DNA construct of this invention can be provided in a composition for topical application to a surface of a plant or of a plant seed, or for topical application to any substrate needing protection from a *Diabrotica* species infestation. Likewise, the recombinant DNA construct can be provided in a composition for topical application to a *Diabrotica* species, or in a composition for ingestion by a *Diabrotica* species. In various embodiments, such compositions containing the recombinant DNA construct are provided in the form of at least one selected from the group consisting of a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. Suitable binders, inert carriers, surfactants, and the like can be included in the composition containing the recombinant DNA construct, as is known to one skilled in formulation of pesticides and seed treatments. In embodiments, the composition containing the recombinant DNA construct further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In one embodiment the composition containing the recombinant DNA construct further includes a nonionic organosilicone surfactant such as Silwet, e. g., Silwet® L-77 surfactant having CAS Number 27306-78-1 and EPA Number: CAL.REG.NO. 5905-50073-AA, currently available from Momentive Performance Materials, Albany, N.Y. In embodiments, the composition containing the recombinant DNA construct further includes at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

It is anticipated that the combination of certain recombinant DNA constructs of this invention (e. g., recombinant DNA constructs including the polynucleotide triggers described in the working Examples), whether transgenically expressed or topically applied, with one or more non-polynucleotide pesticidal agents, whether transgenically expressed or topically applied, will result in a synergetic improvement in prevention or control of *Diabrotica* species infestations, when compared to the effect obtained with the recombinant DNA constructs alone or the non-polynucleotide pesticidal agent alone. In an embodiment, a recombinant DNA construct for expressing one or more polynucleotides of this invention as well as one or more genes encoding a non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein, is found to provide synergistically improved resistance to *Diabrotica* species infestations in plants expressing the recombinant DNA construct.

The composition containing the recombinant DNA construct of this invention can be provided for dietary uptake by a *Diabrotica* species by applying the composition to a plant or surface subject to infestation by the *Diabrotica* species, for example by spraying, dusting, or coating the plant, or by application of a soil drench, or by providing in an artificial diet. The composition containing the recombinant DNA construct can be provided for dietary uptake by a *Diabrotica* species in an artificial diet formulated to meet the particular nutritional requirements for maintaining the *Diabrotica* species, wherein the artificial diet is supplemented with some amount of the recombinant DNA construct obtained from a separate source such as in vitro synthesis or purified from a microbial fermentation or other biological source; this embodiment can be useful, e. g., for determining the timing and amounts of effective treatment regimes. In some embodiments the composition containing the recombinant DNA construct is provided for dietary uptake by the *Diabrotica* species in the form of a plant cell or in plant cell components, or in a microorganism (such as a bacterium or a yeast) or a microbial fermentation product, or in a synthetic diet. In one embodiment the composition containing the recombinant DNA construct is provided in the form of bait that is ingested by the *Diabrotica* species. The composition containing the recombinant DNA construct can be provided for dietary uptake by the *Diabrotica* species in the form of a seed treatment.

In various embodiments, the composition containing the recombinant DNA construct of this invention includes a microbial cell or is produced in a microorganism. For example, the composition for containing the recombinant DNA construct can include or can be produced in bacteria or yeast cells. In similar embodiments the composition containing the recombinant DNA construct includes a transgenic plant cell or is produced in a plant cell (for example a plant cell transiently expressing the polynucleotide); such plant cells can be cells in an plant or cells grown in tissue culture or in cell suspension.

The recombinant DNA construct of this invention is particularly useful for making plants having improved resistance to a *Diabrotica* infestation as well as for making compositions for controlling a *Diabrotica* species. In various embodiments, the *Diabrotica* species to be controlled is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

Transgenic Maize Plant Cells

Another aspect of this invention provides a plant cell expressing any of the recombinant DNA constructs of this invention. Such plant cells include, for example: a transgenic maize plant cell expressing a polynucleotide comprising at least 18 contiguous nucleotides with a sequence of about 95% to about 100% identity with a segment of equivalent length of a DNA having a sequence selected from the group consisting of SEQ ID NOs:1-450 or the DNA complement thereof; a transgenic maize plant cell expressing a polynucleotide having at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof; a transgenic maize plant cell expressing a recombinant RNA comprising at least one silencing element essentially identical or essentially complementary to a target gene of said *Diabrotica* species larvae, wherein said target gene sequence is selected from the group consisting of SEQ ID NOs:1-450 or the complement thereof; a transgenic maize plant cell expressing a polynucleotide comprising at least 18 contiguous nucleotides that are essentially identical or complementary to a segment of equivalent length of a DNA having a sequence selected from the group consisting of SEQ ID NOs:1-450; a transgenic maize plant cell expressing a recombinant DNA construct comprising a heterologous promoter operably linked to DNA comprising at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof; a transgenic maize plant cell expressing a recombinant DNA encoding RNA that suppresses expression of a target gene in a *Diabrotica* species that contacts or ingests said RNA, wherein said RNA comprises at least one silencing element complementary to said target gene, and wherein said target gene sequence is selected from the group consisting of SEQ ID NOs:1-450 or the complement thereof; a transgenic maize plant cell expressing a recombinant RNA molecule comprises at least 18 contiguous nucleotides that are essentially complementary to a segment of equivalent length of a DNA having a sequence selected from the group consisting of SEQ ID NOs:1-450 or the DNA complement thereof; or a transgenic maize plant cell expressing a polynucleotide comprising at least 18 contiguous nucleotides that are essentially identical or complementary to a segment of equivalent length of a DNA of a target gene selected from the group consisting of the genes identified in Table 1. Such plant cells are useful in providing a plant having improved resistance to a *Diabrotica* species infestation when compared to a control plant lacking such plant cells. The plant cell can be an isolated plant cell, or a plant cell grown in culture, or a cell of any plant that is subject to infestation by a *Diabrotica* species. Of particular interest are embodiments wherein the plant cell is a cell of a row crop plant or a vegetable crop plant. Examples include a plant cell selected from the group consisting cells of maize, cucumber, squash, soybeans, and dry beans. Of particular interest is a cell of maize plants, and embodiments include those wherein the plant cell is a cell of an ungerminated maize seed, or of a maize plant in a vegetative stage (from emergence to tasseling stage, i. e., VE, V1, V2, V3, ..., V(n), VT), or of a maize plant in a reproductive stage (R1, R2, R3, R4, R5, R6). One embodiment includes cells of maize plants in a field of maize.

In an embodiment, the recombinant DNA is stably integrated into the plant's genome from where it can be expressed in a cell or cells of the plant according to this invention. Methods of providing stably transformed plants are provided in the section headed "Making and Using Transgenic Plant Cells and Transgenic Plants". Thus, one specific aspect of this invention provides a transgenic maize plant cell having in its genome a recombinant DNA encoding RNA that suppresses expression of a target gene in a *Diabrotica* species that contacts or ingests the RNA, wherein the RNA includes at least one silencing element complementary to the target gene, and wherein the target gene sequence is selected from the group consisting of SEQ ID NOs:1-450 or the complement thereof. Such transgenic maize plant cells are useful in providing a maize plant having improved resistance to a *Diabrotica* species infestation when compared to a control maize plant lacking such transgenic maize plant cells.

Where embodiments where the plant cell of this invention is used in providing a plant exhibiting improved resistance to a *Diabrotica* species, the *Diabrotica* species is at least one selected from the group consisting of *Diabrotica balteata*, *Diabrotica barberi*, *Diabrotica beniensis*, *Diabrotica cristata*, *Diabrotica curvipustulata*, *Diabrotica dissimilis*, *Diabrotica elegantula*, *Diabrotica emorsitans*, *Diabrotica graminea*, *Diabrotica hispanolae*, *Diabrotica lemniscata*, *Diabrotica linsleyi*, *Diabrotica longicornis*, *Diabrotica milleri*, *Diabrotica nummularis*, *Diabrotica occlusa*, *Diabrotica porracea*, *Diabrotica scutellata*, *Diabrotica speciosa*, *Diabrotica tibialis*, *Diabrotica trifasciata*, *Diabrotica undecimpunctata*, *Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

One specific aspect of this invention provides a transgenic maize plant cell having in its genome a recombinant DNA encoding RNA that suppresses expression of a target gene in a *Diabrotica* species that contacts or ingests the RNA, wherein the RNA includes at least one silencing element complementary to the target gene, and wherein the target gene sequence is selected from the group consisting of SEQ ID NOs:1-450 or the complement thereof. In embodiments, the RNA element includes at least 18 contiguous nucleotides with a sequence of about 95% to about 100% identity with a segment of equivalent length of a DNA having a sequence selected from the group consisting of SEQ ID NOs:1-450 or the DNA complement thereof. In embodiments, the RNA element includes at least 18 contiguous nucleotides capable of hybridizing in vivo or of hybridizing under physiological conditions (e. g., such as physiological conditions normally found in the cells of a *Diabrotica* species) to a segment of equivalent length of a DNA having a sequence selected from the group consisting of SEQ ID NOs:1-450.

The RNA element useful in plant cells of this invention can include sense single-stranded RNA (ssRNA) or anti-sense ssRNA (where "sense" and "anti-sense" is in reference to the coding sequences of a target gene such as those with a sequence selected from the group consisting of SEQ ID NOs:1-450), or can include double-stranded RNA (dsRNA) or any combination of these.

The RNA element useful in plant cells of this invention includes at least 18 contiguous nucleotides with a sequence of about 95% to about 100% identity with a segment of equivalent length of a DNA having a sequence selected from the group consisting of SEQ ID NOs:1-450 or the DNA complement thereof. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The RNA element useful in plant cells of this invention is generally designed to suppress one or more genes ("target genes"). Such target genes can include coding or non-coding sequence or both. In specific embodiments, the RNA element is designed to suppress one or more target genes, where each target gene has a DNA sequence selected from the group consisting of SEQ ID NOs:1-450. In various embodiments, the RNA element is designed to suppress one or more genes, where each gene has a sequence selected from the group consisting of SEQ ID NOs:1-450, and can be designed to suppress multiple genes from this group, or to target different regions of one or more of these genes. In an embodiment, the RNA element includes multiple sections or segments each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each section can be identical or different in size or in sequence, and can be sense or anti-sense relative to the target gene. For example, in one embodiment the RNA element can include multiple sections in tandem or repetitive arrangements, wherein each section includes at least 18 contiguous nucleotides with a sequence of about 95% to about 100% identity with a segment of equivalent length of a DNA having a sequence selected from the group consisting of SEQ ID NOs:1-450 or the DNA complement thereof; "spacer" nucleotides which do not correspond to a target gene can optionally be used in between the sections.

The total length of the transcript of the recombinant DNA construct useful in plant cells of this invention can be greater than 18 contiguous nucleotides, and can include nucleotides in addition to the RNA element having the sequence of about 95% to about 100% identity with a segment of equivalent length of a DNA having a sequence selected from the group consisting of SEQ ID NOs:1-450 or the DNA complement thereof. In other words, the total length of the transcript of the recombinant DNA construct can be greater than the length of the RNA element designed to suppress one or more target genes, where each target gene has a DNA sequence selected from the group consisting of SEQ ID NOs:1-450. For example, the transcript of the recombinant DNA construct can have nucleotides flanking the "active" RNA element of at least 18 contiguous nucleotides that suppresses the target gene, or include "spacer" nucleotides between active segments, or can have additional nucleotides at the 5' end, or at the 3' end, or at both the 5' and 3' ends. In an embodiment, the transcript of the recombinant DNA construct can include additional nucleotides that provide stabilizing secondary structure.

The transcript of the recombinant DNA construct useful in plant cells of this invention has at least one RNA element of 18 or more contiguous nucleotides with a sequence of about 95% to about 100% identity with a segment of equivalent length of a DNA having a sequence selected from the group consisting of SEQ ID NOs:1-450 or the DNA complement thereof. In an embodiment the RNA element includes at least 18 contiguous nucleotides that are essentially identical or complementary to a segment of equivalent length of a DNA having a sequence selected from the group consisting of SEQ ID NOs:1-450. In some embodiments, the contiguous nucleotides have a sequence of about 95%, about 96%, about 97%, about 98%, about 99%, or about 100% identity with the segment of equivalent length of a DNA having a sequence selected from the group consisting of SEQ ID NOs:1-450 or the DNA complement thereof. In some embodiments the contiguous nucleotides are exactly (100%) identical to a segment of equivalent length of a DNA having a sequence selected from the group consisting of SEQ ID NOs:1-450 or the DNA complement thereof. In some embodiments, the RNA element has an overall sequence of about 95%, about 96%, about 97%, about 98%, about 99%, or about 100% identity with a segment of a DNA having a sequence selected from the group consisting of SEQ ID NOs:1-450 or the DNA complement thereof.

In embodiments, the plant cell is further capable expressing additional heterologous DNA sequences. For example, a transgenic maize plant cell can have a genome that further includes recombinant DNA encoding at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

In a related aspect, this invention is directed to a plant having improved resistance to a *Diabrotica* species infestation, such as a transgenic maize plant including a transgenic maize plant cell expressing a recombinant DNA construct encoding an RNA element for suppressing one or more target genes with a sequence selected from the group consisting of SEQ ID NOs:1-450. In yet another aspect, this invention is directed to seed (especially transgenic progeny seed) produced by the transgenic maize plant having improved resistance to a *Diabrotica* species infestation, as provided by this method. Also contemplated is a commodity product produced by the transgenic maize plant having improved resistance to a *Diabrotica* species infestation, as provided by this method, and a commodity product produced from the transgenic progeny seed of such a transgenic maize plant.

Recombinant RNA Molecules for Controlling *Diabrotica* Species

Another aspect of this invention provides a recombinant RNA molecule that causes mortality or stunting of growth in a *Diabrotica* species when ingested or contacted by the *Diabrotica* species, wherein the recombinant RNA molecule includes at least 18 contiguous nucleotides that are essentially complementary to a segment of equivalent length of a DNA having a sequence selected from the group consisting of SEQ ID NOs:1-450 or the DNA complement thereof. In one embodiment the recombinant RNA molecule includes at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. In this context "controlling" includes inducement of a physiological or behavioural change such as, but not limited to, growth stunting, increased mortality, decrease in reproductive capacity, decrease in or cessation of feeding behavior or movement, or decrease in or cessation of metamorphosis stage development. Generally the recombinant RNA molecule has been isolated, that is, substantially purified from a mixture such as from a fermentation or from an in vitro synthesis mixture. Such a purified recombinant RNA molecule can of course be combined with other components to form compositions wherein the recombinant RNA molecule is an active agent, or can be combined with other nucleic acid elements, e. g., in a chimeric RNA molecule.

The recombinant RNA molecule of this invention is useful in the manufacture of compositions that can be applied to a plant or other surface in need of protection from a *Diabrotica* species infestation. The recombinant RNA molecule is useful in the manufacture of compositions for controlling a *Diabrotica* species that contacts or ingests such a composition. In various embodiments, the *Diabrotica* species to be controlled is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

Embodiments of the recombinant RNA molecule of this invention include at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. In some embodiments, the segment of 18 or more contiguous nucleotides has a sequence with about 95%, about 96%, about 97%, about 98%, about 99%, or about 100% identity with the segment of equivalent length of a DNA having a sequence selected from the group consisting of SEQ ID NOs:1-450 or the DNA complement thereof. In some embodiments the contiguous nucleotides are exactly (100%) identical to a segment of equivalent length of a DNA having a sequence selected from the group consisting of SEQ ID NOs:1-450 or the DNA complement thereof. In some embodiments, the DNA has an overall sequence of about 95%, about 96%, about 97%, about 98%, about 99%, or about 100% identity with a DNA having a sequence selected from the group consisting of SEQ ID NOs:1-450 or the DNA complement thereof.

Embodiments of the recombinant RNA molecule of this invention include at least one segment of 18 or more contiguous nucleotides designed to suppress expression of a target gene having a sequence selected from the group consisting of SEQ ID NOs:1-450 or the DNA complement thereof. The contiguous nucleotides of the segment number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The recombinant RNA molecule of this invention is generally designed to suppress one or more genes ("target genes"). Such target genes can include coding or non-coding sequence or both. In specific embodiments, the recombinant RNA molecule is designed to suppress one or more target genes, where each target gene has a DNA sequence selected from the group consisting of SEQ ID NOs:1-450. In various embodiments, the recombinant RNA molecule is designed to suppress one or more genes, where each gene has a sequence selected from the group consisting of SEQ ID NOs:1-450, and can be designed to suppress multiple genes from this group, or to target different regions of one or more of these genes. Embodiments of the recombinant RNA molecule include at least one segment of 18 or more contiguous nucleotides having a sequence designed to suppress one or more genes, where each gene has a sequence selected from the group consisting of SEQ ID NOs:1-450. In an embodiment, the recombinant RNA molecule includes multiple sections or segments each of which includes at least 18 contiguous nucleotides with a sequence of about 95% to about 100% identity with a segment of equivalent length of a DNA having a sequence selected from the group consisting of SEQ ID NOs:1-450 or the DNA complement thereof. In such cases, each section can be identical or different in size or in sequence, and can be sense or anti-sense relative to the target gene. For example, in one embodiment the recombinant RNA molecule includes multiple sections in tandem or repetitive arrangements, wherein each section includes at least 18 contiguous nucleotides with a sequence of about 95% to about 100% identity with a segment of equivalent length of a DNA having a sequence selected from the group consisting of SEQ ID NOs:1-450 or the DNA complement thereof; "spacer" nucleotides which do not correspond to a target gene can optionally be used in between the sections.

The recombinant RNA molecule of this invention can have a total length that is greater than 18 contiguous nucleotides, and can include nucleotides in addition to the segment of at least 18 contiguous nucleotides having the sequence of about 95% to about 100% identity with a segment of equivalent length of a DNA having a sequence selected from the group consisting of SEQ ID NOs:1-450 or the DNA complement thereof. In other words, the total length of the recombinant RNA molecule can be greater than the length of the segment of the recombinant RNA molecule which is designed to suppress one or more target genes, where each target gene has a DNA sequence selected from the group consisting of SEQ ID NOs:1-450. For example, the recombinant RNA molecule can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the recombinant RNA molecule can include or encode additional nucleotides that provide stabilizing secondary structure.

The recombinant RNA molecule of this invention can be single-stranded (ss) or double-stranded (ds) or a combination of both. Embodiments of the recombinant RNA molecule include sense single-stranded RNA (ssRNA), anti-sense ssRNA, or double-stranded RNA (dsRNA), or a combination of any of these.

The recombinant RNA molecule of this invention is provided by suitable means known to one in the art. Embodiments include those wherein the recombinant RNA molecule is synthesized in vitro, produced by expression in a microorganism or in cell culture (such as plant or insect cells grown in culture), produced by expression in a plant cell, or produced by microbial fermentation.

In some embodiments the recombinant RNA molecule of this invention includes other RNA elements, such as RNA aptamers or ribozymes, additional non-coding RNA (e. g., additional suppression elements), or one or more recognition sites for binding and cleavage by a small RNA (e. g., by a miRNA or an siRNA that is expressed only in a particular cell or tissue).

The recombinant RNA molecule of this invention can be provided in a composition for topical application to a surface of a plant or of a plant seed, or for topical application to any substrate needing protection from a *Diabrotica* species infestation. Likewise, the recombinant RNA molecule can be provided in a composition for topical application to a *Diabrotica* species, or in a composition for ingestion by a *Diabrotica* species. In various embodiments, such compositions containing the recombinant RNA molecule are provided in the form of at least one selected from the group consisting of a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. Suitable binders, inert carriers, surfactants, and the like can included in the composition containing the recombinant RNA molecule, as is known to one skilled in formulation of pesticides and seed treatments. In embodiments, the composition containing the recombinant RNA molecule further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In one embodiment the composition containing the recombinant RNA molecule further includes a nonionic organosilicone surfactant such as Silwet, e. g., Silwet® L-77 surfactant having CAS Number 27306-78-1 and EPA Number: CAL.REG.NO. 5905-50073-AA, currently available from Momentive Performance Materials, Albany, N.Y. In embodiments, the composition containing the recombinant RNA molecule further includes at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

The composition containing the recombinant RNA molecule of this invention can be provided for dietary uptake by a *Diabrotica* species by applying the composition to a plant or surface subject to infestation by the *Diabrotica* species, for example by spraying, dusting, or coating the plant, or by application of a soil drench, or by providing in an artificial diet. The composition containing the recombinant RNA molecule can be provided for dietary uptake by a *Diabrotica* species in an artificial diet formulated to meet the particular nutritional requirements for maintaining the *Diabrotica* species, wherein the artificial diet is supplemented with some amount of the recombinant RNA molecule obtained from a separate source such as in vitro synthesis or purified from a microbial fermentation or other biological source; this embodiment can be useful, e. g., for determining the timing and amounts of effective treatment regimes. In some embodiments the composition containing the recombinant RNA molecule is provided for dietary uptake by the *Diabrotica* species in the form of a plant cell or in plant cell components, or in a microorganism (such as a bacterium or a yeast) or a microbial fermentation product, or in a synthetic diet. In one embodiment the composition containing the recombinant RNA molecule is provided in the form of bait that is ingested by the *Diabrotica* species. The composition containing the recombinant RNA molecule can be provided for dietary uptake by the *Diabrotica* species in the form of a seed treatment.

In various embodiments, the composition containing the recombinant RNA molecule of this invention includes a microbial cell or is produced in a microorganism. For example, the composition for containing the recombinant RNA molecule can include or can be produced in bacteria or yeast cells. In similar embodiments the composition containing the recombinant RNA molecule includes a transgenic plant cell or is produced in a plant cell (for example a plant cell transiently expressing the polynucleotide); such plant cells can be cells in an plant or cells grown in tissue culture or in cell suspension.

Methods of Providing Plants Having Improved Resistance to *Diabrotica* Species Infestations, and the Plants and Seeds Thus Provided Another aspect of this invention provides a method of providing a plant having improved resistance to a *Diabrotica* species infestation including providing to the plant at least one polynucleotide including at least 18 contiguous nucleotides that are essentially identical or complementary to a segment of equivalent length of a DNA of a target gene selected from the group consisting of the genes identified in Table 1. Embodiments of these target genes are identified by name in Table 1 and include genes having a sequence selected from the group consisting of SEQ ID NOs:1-450, as well as related genes including orthologues from related insect species, for example related genes from other *Diabrotica* species, *Tribolium* species, or other related genera. Examples of such target genes include the *Tribolium castaneum* genes listed in Table 1.

The plant can be any plant that is subject to infestation by a *Diabrotica* species. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize.

In various embodiments, the *Diabrotica* species is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

In one embodiment the method includes topically applying to the plant a composition including at least one polynucleotide including at least 18 contiguous nucleotides that are essentially identical or complementary to a segment of equivalent length of a DNA of a target gene selected from the group consisting of the genes identified in Table 1, whereby the plant treated with the polynucleotide composition exhibits improved resistance to a *Diabrotica* species infestation, relative to an untreated plant.

By "topical application" is meant application to the surface or exterior of an object, such as the surface or exterior of a plant, such as application to the surfaces of a plant part such as a leaf, stem, flower, fruit, shoot, root, seed, tuber, flowers, anthers, or pollen, or application to an entire plant, or to the above-ground or below-ground portions of a plant. Topical application can be carried out on non-living surfaces, such as application to soil, or to a surface or matrix by which a *Diabrotica* insect can come in contact with the polynucleotide. In various embodiments of the method, the composition including at least one polynucleotide is topically applied to the plant in a suitable form, e. g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. Topical application of the polynucleotide-containing composition to the plant can be in the form of a seed treatment. Suitable binders, inert carriers, surfactants, and the like can optionally be included in the composition, as is known to one skilled in formulation of pesticides and seed treatments. In one embodiment the polynucleotide-containing composition can be ingested or otherwise absorbed internally by the *Diabrotica* species. For example, the polynucleotide-containing composition can be in the form of bait. In embodiments, the polynucleotide-containing composition further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In one embodiment the composition further includes a nonionic organosilicone surfactant such as Silwet, e. g., Silwet® L-77 surfactant having CAS Number 27306-78-1 and EPA Number: CAL.REG.NO. 5905-50073-AA, currently available from Momentive Performance Materials, Albany, N.Y. In embodiments, the topically applied composition further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein. Alternatively such additional components or pesticidal agents can be provided separately, e. g., by separate topical application or by transgenic expression in the plant. Alternatively the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as Silwet, e. g., Silwet® L-77, followed by a second topical application of the polynucleotide-containing composition, or vice-versa.

It is anticipated that the combination of certain polynucleotides of this invention (e. g., the polynucleotide triggers described in the working Examples) with one or more non-polynucleotide pesticidal agents will result in a synergetic improvement in prevention or control of *Diabrotica* species infestations, when compared to the effect obtained with the polynucleotide alone or the non-polynucleotide pesticidal agent alone. In an embodiment, a composition containing one or more polynucleotides of this invention and one or more non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein, is found to effect synergistically improved prevention or control of *Diabrotica* species infestations when topically applied to a plant.

In some embodiments of the method of this invention, the composition including at least one polynucleotide is topically applied to above-ground parts of the plant, e. g., sprayed or dusted onto leaves, stems, and flowering parts of the plant. In other embodiments, the composition including at least one polynucleotide is topically applied to below-ground parts of the plant, such as to the roots, e. g., by means of a soil drench. In other embodiments, the composition including at least one polynucleotide is topically applied to a seed that is grown into the plant.

In embodiments, the method of this invention includes topically applying to the plant a composition including at least one polynucleotide including at least 18 contiguous nucleotides that are essentially identical or complementary to a segment of equivalent length of a DNA of a target gene selected from the group consisting of the genes identified in Table 1. The polynucleotide topically applied to the plant can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the polynucleotide topically applied to the plant is at least one selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used.

In various embodiments of this invention the polynucleotide topically applied to the plant consists of naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In certain embodiments, the polynucleotide includes non-canonical nucleotides such as inosine, thiouridine, or pseudouridine. In certain embodiments, the polynucleotide includes chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e. g., fluorescein or rhodamine) or other label (e. g., biotin).

The polynucleotide topically applied to the plant is provided by suitable means known to one in the art. Embodiments include those wherein the polynucleotide is chemically synthesized (e. g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments of this invention the polynucleotide topically applied to the plant is provided as an isolated DNA or RNA fragment (not part of an expression construct, i. e., lacking additional elements such as a promoter or terminator sequences). Such polynucleotides can be relatively short, such as single- or double-stranded polynucleotides of between about 18 to about 200 or about 300 nucleotides (for single-stranded polynucleotides) or between about 18 to about 200 or about 300 base-pairs (for double-stranded polynucleotides). Alternatively the polynucleotide can be provided in more complex constructs, e. g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e. g., an insecticidal protein).

The polynucleotide topically applied to the plant has at least one segment of 18 or more contiguous nucleotides that are essentially identical or complementary to a segment of equivalent length of a DNA of a target gene selected from the group consisting of the genes identified in Table 1, or that have a sequence of about 95% to about 100% identity with a segment of equivalent length of a DNA of a target gene selected from the group consisting of the genes identified in Table 1. In an embodiment the polynucleotide topically applied to the plant includes at least 18 contiguous nucleotides that are essentially identical or complementary to a segment of equivalent length of a DNA of a target gene selected from the group consisting of the genes identified in Table 1. In some embodiments, the contiguous nucleotides have a sequence of about 95%, about 96%, about 97%, about 98%, about 99%, or about 100% identity or complementarity with the segment of equivalent length of a DNA of a target gene selected from the group consisting of the genes identified in Table 1. In some embodiments the contiguous nucleotides are exactly (100%) identical or complementary to a segment of equivalent length of a DNA of a target gene selected from the group consisting of the genes identified in Table 1. In some embodiments, the polynucleotide has an overall sequence of about 95%, about 96%, about 97%, about 98%, about 99%, or about 100% identity or complementarity with a segment of a DNA of a target gene selected from the group consisting of the genes identified in Table 1.

The polynucleotide topically applied to the plant includes at least 18 contiguous nucleotides with a sequence of about 95% to about 100% identity or complementarity with a segment of equivalent length of a DNA of a target gene selected from the group consisting of the genes identified in Table 1. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The polynucleotide topically applied to the plant is generally designed to suppress one or more genes ("target genes"). Such target genes can include coding or non-coding sequence or both. In specific embodiments, the polynucleotide is designed to suppress one or more target genes selected from the group consisting of the genes identified in Table 1. In embodiments, each target gene has a DNA sequence selected from the group consisting of SEQ ID NOs:1-450. In various embodiments, the polynucleotide topically applied to the plant is designed to suppress one or more genes, where each gene is selected from the group consisting of the genes identified in Table 1, and can be designed to suppress multiple genes from this group, or to target different regions of one or more of these genes. In an embodiment, the polynucleotide topically applied to the plant includes multiple sections or segments each of which includes at least 18 contiguous nucleotides with a sequence of about 95% to about 100% identity or complementarity with a segment of equivalent length of a DNA of a target gene selected from the group consisting of the genes identified in Table 1. In such cases, each section can be identical or different in size or in sequence, and can be sense or anti-sense relative to the target gene. For example, in one embodiment the polynucleotide topically applied to the plant can include multiple sections in tandem or repetitive arrangements, wherein each section includes at least 18 contiguous nucleotides with a sequence of about 95% to about 100% identity or complementarity with a segment of equivalent length of a DNA of a target gene selected from the group consisting of the genes identified in Table 1; "spacer" nucleotides which do not correspond to a target gene can optionally be used in between the sections.

The total length of the polynucleotide topically applied to the plant can be greater than 18 contiguous nucleotides, and can include nucleotides in addition to the contiguous nucleotides having the sequence of about 95% to about 100% identity or complementarity with a segment of equivalent length of a DNA of a target gene selected from the group consisting of the genes identified in Table 1. In other words, the total length of the polynucleotide topically applied to the plant can be greater than the length of the section or segment of the polynucleotide designed to suppress one or more target genes, where each target gene is selected from the group consisting of the genes identified in Table 1. For example, the polynucleotide topically applied to the plant can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the polynucleotide topically applied to the plant can include additional nucleotides that provide stabilizing secondary structure.

In a related aspect, this invention is directed to the plant having improved resistance to a *Diabrotica* species infestation, provided by this method which includes topically applying to the plant a composition including at least one polynucleotide including at least 18 contiguous nucleotides that are essentially identical or complementary to a segment of equivalent length of a DNA of a target gene selected from the group consisting of the genes identified in Table 1, whereby the plant treated with the polynucleotide composition exhibits improved resistance to a *Diabrotica* species infestation, relative to an untreated plant. In yet another aspect, this invention is directed to seed (especially transgenic progeny seed) produced by the plant having improved resistance to a *Diabrotica* species infestation, as provided by this method. Also contemplated is a commodity product produced by the plant having improved resistance to a *Diabrotica* species infestation, as provided by this method, and a commodity product produced from the transgenic progeny seed of such a plant.

In another embodiment the method of this invention includes expressing in the plant at least one polynucleotide including at least 18 contiguous nucleotides that are essentially identical or complementary to a segment of equivalent length of a DNA of a target gene selected from the group consisting of the genes identified in Table 1, whereby the plant expressing the polynucleotide exhibits improved resistance to a *Diabrotica* species infestation, relative to an plant not expressing the polynucleotide. In an embodiment the method includes expressing in the plant at least one polynucleotide including at least one segment of 18 or more contiguous nucleotides with a sequence of about 95% to about 100% identity or complementarity with a segment of equivalent length of a DNA of a target gene selected from the group consisting of the genes identified in Table 1. By "expressing a polynucleotide in the plant" is generally meant "expressing an RNA transcript in the plant". However, the polynucleotide expressed in the plant can also be DNA, e. g., a DNA produced in the plant during genome replication.

The plant can be any plant that is subject to infestation by a *Diabrotica* species. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, . . . , V(n), VT), or a maize plant in a reproductive stage (R1, R2, R3, R4, R5, R6). One embodiment includes maize plants in a field of maize.

In various embodiments, the *Diabrotica* species is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera,* and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

In some embodiments of the method including expressing at least one polynucleotide in a plant, a first polynucleotide can be provided to a plant in the form of DNA (e. g., in the form of an isolated DNA molecule, or as an expression construct, or as a transformation vector), and the polynucleotide expressed in the plant is a second polynucleotide (an RNA transcript) in the plant. In an embodiment, the polynucleotide is expressed in the plant by transgenic expression, i. e., by stably integrating the polynucleotide into the plant's genome from where it can be expressed in a cell or cells of the plant. In an embodiment, a first polynucleotide (e. g., a recombinant DNA construct including a promoter operably linked to DNA encoding an RNA silencing element for suppressing a target gene selected from the group consisting of the genes identified in Table 1) is stably integrated into the plant's genome from where secondarily produced polynucleotides (e. g., an RNA transcript including the RNA silencing element for suppressing the target gene) can be expressed in a cell or cells of the plant. Methods of providing stably transformed plant are provided in the section headed "Making and Using Transgenic Plant Cells and Transgenic Plants".

In another embodiment of this invention the polynucleotide is expressed by transient expression. In such embodiments the method can include a step of introducing a polynucleotide into the plant by routine techniques known in the art. For example, transient expression can be accomplished by infiltration of a polynucleotide solution using a needle-less syringe into a leaf of a plant.

In some embodiments of this invention where the polynucleotide is expressed by transient expression, a first polynucleotide is provided to a plant in the form of RNA or DNA or both RNA and DNA, and a secondarily produced second polynucleotide is transiently expressed in the plant. In embodiments, the first polynucleotide is one or more selected from: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, and (i) a double-stranded, hybridized RNA/DNA molecule, or combinations thereof. In embodiments, a first polynucleotide is introduced into the plant by topical application to the plant of a polynucleotide-containing composition in a suitable form, e. g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. Topical application of the polynucleotide-containing composition to the plant can be in the form of a seed treatment. Suitable binders, inert carriers, surfactants, and the like can optionally be included in the composition, as is known to one skilled in formulation of pesticides and seed treatments. In embodiments, the polynucleotide-containing composition further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In one embodiment the composition further includes a nonionic organosilicone surfactant such as Silwet, e. g., Silwet® L-77 surfactant having CAS Number 27306-78-1 and EPA Number: CAL.REG.NO. 5905-50073-AA, currently available from Momentive Performance Materials, Albany, N.Y. In embodiments, the topically applied composition further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein. Alternatively such additional components or pesticidal agents can be provided separately, e. g., by separate topical application or by transgenic expression in the plant. Alternatively the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as Silwet, e. g., Silwet® L-77, followed by a second topical application of the polynucleotide-containing composition, or vice-versa.

It is anticipated that the combination of certain polynucleotides useful in methods of this invention (e. g., the polynucleotide triggers described in the working Examples) with one or more non-polynucleotide pesticidal agents will result in a synergetic improvement in prevention or control of *Diabrotica* species infestations, when compared to the effect obtained with the polynucleotide alone or the non-polynucleotide pesticidal agent alone. In an embodiment, a transgenic plant expressing one or more polynucleotides of this invention and one or more genes encoding a non-polynucleotide pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein, is found to exhibit synergistically improved resistance to *Diabrotica* species infestations.

In embodiments of this invention where the polynucleotide is expressed by transient expression, a first polynucleotide is provided to a plant in the form of RNA or DNA or both RNA and DNA, and a secondarily produced second polynucleotide is transiently expressed in the plant; the site of application of the first polynucleotide need not be the same site where the second polynucleotide is transiently expressed. For example, a first polynucleotide can be provided to a plant by topical application onto a leaf, or by injection into a stem, and the second polynucleotide can be transiently expressed elsewhere in the plant, e. g., in the roots or throughout the plant. In some embodiments of the method, a composition including at least one polynucleotide is topically applied to above-ground parts of the plant, e. g., sprayed or dusted onto leaves, stems, and flowering parts of the plant. In other embodiments, a composition including at least one polynucleotide is topically applied to below-ground parts of the plant, such as to the roots, e. g., by means of a soil drench. In other embodiments, a composition including at least one polynucleotide is topically applied to a seed that is grown into the plant having improved resistance to a *Diabrotica* species infestation.

The topically applied polynucleotide can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the polynucleotide is at least one selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used.

In some embodiments of this invention a first polynucleotide (DNA or RNA or both) is topically applied to a plant and a second polynucleotide having a sequence corresponding to the first polynucleotide is subsequently expressed in the plant. In such embodiments the polynucleotide expressed in the plant is an RNA transcript which can be ssRNA or dsRNA or both. In various embodiments the first polynucleotide consists of naturally occurring nucleotides, such as those which occur in DNA and RNA. In other embodiments the first polynucleotide is chemically modified, or includes chemically modified nucleotides. The first polynucleotide is provided by suitable means known to one in the art. Embodiments include those wherein the first polynucleotide is chemically synthesized (e. g., by in vitro transcription, such as transcription using a T7 polymerase or other polymerase), produced by expression in a microorganism or in cell culture (such as plant or insect cells grown in culture), produced by expression in a plant cell, or produced by microbial fermentation. The first polynucleotide can be provided as an RNA or DNA fragment. Alternatively the first polynucleotide can be provided in more complex constructs, e. g., as part of a recombinant expression construct, or included in a recombinant vector, for example in a recombinant plant virus vector or in a recombinant baculovirus vector; such recombinant expression constructs or vectors can be designed to include additional elements, such as expression cassettes for expressing a gene of interest (e. g., an insecticidal protein).

In many embodiments of this invention the polynucleotide expressed in the plant is an isolated RNA fragment and can be relatively short, such as single- or double-stranded RNAs of between about 18 to about 200 or about 300 nucleotides (for single-stranded RNAs) or between about 18 to about 200 or about 300 base-pairs (for double-stranded RNAs).

The polynucleotide expressed in the plant has at least one segment of 18 or more contiguous nucleotides with a sequence of about 95% to about 100% identity or complementarity with a segment of equivalent length of a DNA of a target gene selected from the group consisting of the genes identified in Table 1. In an embodiment the polynucleotide expressed in the plant includes at least 18 contiguous nucleotides that are essentially identical or complementary to a segment of equivalent length of a DNA of a target gene selected from the group consisting of the genes identified in Table 1. In some embodiments, the contiguous nucleotides have a sequence of about 95%, about 96%, about 97%, about 98%, about 99%, or about 100% identity or complementarity with the segment of equivalent length of a DNA of a target gene selected from the group consisting of the genes identified in Table 1. In some embodiments the contiguous nucleotides are exactly (100%) identical or complementary to a segment of equivalent length of a DNA of a target gene selected from the group consisting of the genes identified in Table 1. In some embodiments, the polynucleotide has an overall sequence of about 95%, about 96%, about 97%, about 98%, about 99%, or about 100% identity or complementarity with a segment of a DNA of a target gene selected from the group consisting of the genes identified in Table 1.

The polynucleotide expressed in the plant includes at least 18 contiguous nucleotides with a sequence of about 95% to about 100% identity or complementarity with a segment of equivalent length of a DNA of a target gene selected from the group consisting of the genes identified in Table 1. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The polynucleotide expressed in the plant is generally designed to suppress one or more genes ("target genes"). Such target genes can include coding or non-coding sequence or both. In specific embodiments, the polynucleotide expressed in the plant is designed to suppress one or more target genes, where at least one target gene is selected from the group consisting of the genes identified in Table 1. In various embodiments, the polynucleotide expressed in the plant is designed to suppress one or more genes, where each target gene is selected from the group consisting of the genes identified in Table 1, and can be designed to suppress multiple genes from this group, or to target different regions of one or more of these genes. In an embodiment, the polynucleotide expressed in the plant includes multiple sections or segments each of which includes at least 18 contiguous nucleotides with a sequence of about 95% to about 100% identity or complementarity with a segment of equivalent length of a DNA of a target gene selected from the group consisting of the genes identified in Table 1. In such cases, each section can be identical or different in size or in sequence, and can be sense or anti-sense relative to the target gene. For example, in one embodiment the polynucleotide expressed in the plant can include multiple sections in tandem or repetitive arrangements, wherein each section includes at least 18 contiguous nucleotides with a sequence of about 95% to about 100% identity or complementarity with a segment of equivalent length of a DNA of a target gene selected from the group consisting of the genes identified in Table 1; "spacer" nucleotides which do not correspond to a target gene can optionally be used in between the sections.

The total length of the polynucleotide expressed in the plant can be greater than 18 contiguous nucleotides, and can include nucleotides in addition to the contiguous nucleotides having the sequence of about 95% to about 100% identity or complementarity with a segment of equivalent length of a DNA of a target gene selected from the group consisting of the genes identified in Table 1. In other words, the total length of the polynucleotide expressed in the plant can be greater than the length of the section or segment of the polynucleotide designed to suppress one or more target genes, where each target gene is selected from the group consisting of the genes identified in Table 1. For example, the polynucleotide expressed in the plant can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the polynucleotide expressed in the plant can include additional nucleotides that provide stabilizing secondary structure.

In a related aspect, this invention is directed to the plant having improved resistance to a *Diabrotica* species infestation, provided by expressing in the plant at least one polynucleotide including at least 18 contiguous nucleotides that are essentially identical or complementary to a segment of equivalent length of a DNA of a target gene selected from the group consisting of the genes identified in Table 1, whereby the resulting plant has improved resistance to a *Diabrotica* species infestation when compared to a control plant in which the polynucleotide is not expressed. In a related aspect, this invention is directed to the plant having improved resistance to a *Diabrotica* species infestation, provided by expressing in the plant at least one polynucleotide including at least one segment of 18 or more contiguous nucleotides with a sequence of about 95% to about 100% identity or complementarity with a segment of equivalent length of a DNA of a target gene selected from the group consisting of the genes identified in Table 1, whereby the resulting plant has improved resistance to a *Diabrotica* species infestation when compared to a control plant in which the polynucleotide is not expressed. In yet another aspect, this invention is directed to seed (especially transgenic progeny seed) produced by the plant having improved resistance to a *Diabrotica* species infestation, as provided by this method. Also contemplated is a commodity product produced by the plant having improved resistance to a *Diabrotica* species infestation, as provided by this method, and a commodity product produced from the transgenic progeny seed of such a plant.

Methods of Controlling *Diabrotica* Species Infestations of a Plant

Another aspect of this invention provides a method for controlling a *Diabrotica* species infestation of a plant including contacting the *Diabrotica* species with a polynucleotide including at least 18 contiguous nucleotides that are essentially identical or complementary to a segment of equivalent length of a target gene selected from the group consisting of the genes identified in Table 1. Embodiments of these target genes are identified by name in Table 1 and include genes having a sequence selected from the group consisting of SEQ ID NOs:1-450, as well as related genes including orthologues from related insect species, for example, related genes from other *Diabrotica* species, *Tribolium* species, or other related coleopteran genera. Examples of such related genes include the *Tribolium castaneum* genes listed in Table 1. In this context "controlling" includes inducement of a physiological or behavioural change such as, but not limited to, growth stunting, increased mortality, decrease in reproductive capacity, decrease in or cessation of feeding behavior or movement, or decrease in or cessation of metamorphosis stage development.

In various embodiments, the *Diabrotica* species is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera*, and *Diabrotica viridula*. In specific embodiments, the *Diabrotica* species is at least one selected from the group consisting of *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

The plant can be any plant that is subject to infestation by a *Diabrotica* species. Of particular interest are embodiments wherein the plant is a row crop plant or a vegetable crop plant. Examples include a plant selected from the group consisting of maize, cucumber, squash, soybeans, and dry beans. One row crop plant of interest is maize, and embodiments include those wherein the plant is an ungerminated maize seed, or a maize plant in a vegetative stage (from emergence to tasseling stage, i. e., VE, V1, V2, V3, ..., V(n), VT), or a maize plant in a reproductive stage (R1, R2, R3, R4, R5, R6). One embodiment includes maize plants in a field of maize.

The polynucleotide of use in methods of this invention can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments of the method include those wherein the polynucleotide is at least one selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used.

The polynucleotide of use in methods of this invention includes at least 18 contiguous nucleotides that are essentially identical or complementary to a segment of equivalent length of a target gene selected from the group consisting of the genes identified in Table 1. In some embodiments, the contiguous nucleotides have a sequence of about 95%, about 96%, about 97%, about 98%, about 99%, or about 100% identity or complementarity with the segment of equivalent length of a target gene selected from the group consisting of the genes identified in Table 1. In some embodiments the contiguous nucleotides are exactly (100%) identical or complementary to a segment of equivalent length of a target gene selected from the group consisting of the genes identified in Table 1. In some embodiments, the polynucleotide has an overall sequence of about 95%, about 96%, about 97%, about 98%, about 99%, or about 100% identity or complementarity with a segment of equivalent length of a target gene selected from the group consisting of the genes identified in Table 1.

Polynucleotides of use in methods of this invention include at least 18 contiguous nucleotides with a sequence of about 95% to about 100% identity or complementarity with a segment of equivalent length of a target gene selected from the group consisting of the genes identified in Table 1. The contiguous nucleotides number at least 18, e. g., between 18-24, or between 18-28, or between 20-30, or between 20-50, or between 20-100, or between 50-100, or between 100-250, or between 100-500, or between 200-1000, or between 500-2000, or even greater, for example, up to the entire length of an open reading frame or up to the entire length of a gene or nucleotide sequence to be suppressed. The contiguous nucleotides can number more than 18, e. g., 19, 20, 21, 22, 23, 24, 25, 26, 27, 28, 29, 30, or greater than 30, e. g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, or greater than 300.

The polynucleotide of use in methods of this invention is generally designed to suppress one or more genes ("target genes"). The term "gene" refers to any portion of a nucleic acid that provides for expression of a transcript or encodes a transcript. A "gene" thus includes, but is not limited to, a promoter region, 5' untranslated regions, transcript encoding regions that can include intronic regions, and 3' untranslated regions. Thus, the target genes can include coding or non-coding sequence or both. In specific embodiments, the polynucleotide is designed to suppress one or more target genes, where at least one target gene is selected from the group consisting of the genes identified in Table 1. In various embodiments, the polynucleotide is designed to suppress one or more genes, where each gene is selected from the group consisting of the genes identified in Table 1, and can be designed to suppress multiple genes from this group, or to target different regions of one or more of these genes. In an embodiment, the polynucleotide includes multiple sections or segments each of which includes at least 18 contiguous nucleotides with a sequence of about 95% to about 100% identity or complementarity with a segment of equivalent length of a target gene selected from the group consisting of the genes identified in Table 1. In such cases, each section can be identical or different in size or in sequence, and can be sense or anti-sense relative to the target gene. For example, in one embodiment the polynucleotide can include multiple sections in tandem or repetitive arrangements, wherein each section includes at least 18 contiguous nucleotides with a sequence of about 95% to about 100% identity or complementarity with a segment of equivalent length of a target gene selected from the group consisting of the genes identified in Table 1; "spacer" nucleotides which do not correspond to a target gene can optionally be used in between the sections.

The total length of the polynucleotide of use in methods of this invention can be greater than 18 contiguous nucleotides, and can include nucleotides in addition to the contiguous nucleotides having the sequence of about 95% to about 100% identity or complementarity with a segment of equivalent length of a target gene selected from the group consisting of the genes identified in Table 1. In other words, the total length of the polynucleotide can be greater than the length of the section or segment of the polynucleotide designed to suppress one or more target genes, where each target gene is selected from the group consisting of the genes identified in Table 1. For example, the polynucleotide can have nucleotides flanking the "active" segment of at least 18 contiguous nucleotides that suppresses the target gene, or include "spacer" nucleotides between active segments, or can have additional nucleotides at the 5' end, or at the 3' end, or at both the 5' and 3' ends. In an embodiment, the polynucleotide can include additional nucleotides that provide stabilizing secondary structure.

In various embodiments the polynucleotide of use in methods of this invention consists of naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In certain embodiments, the polynucleotide includes non-canonical nucleotides such as inosine, thiouridine, or pseudouridine. In certain embodiments, the polynucleotide includes chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e. g., fluorescein or rhodamine) or other label (e. g., biotin).

The polynucleotide of use in methods of this invention is provided by suitable means known to one in the art. Embodiments include those wherein the polynucleotide is chemically synthesized (e. g., by in vitro transcription, such as transcription using a T7 polymerase or other polymerase), produced by expression in a microorganism or in cell culture (such as plant or insect cells grown in culture), produced by expression in a plant cell, or produced by microbial fermentation.

In many embodiments the polynucleotide of use in methods of this invention is provided as an isolated DNA or RNA fragment (not part of an expression construct, i. e., lacking additional elements such as a promoter or terminator sequences). Such polynucleotides can be relatively short, such as single- or double-stranded polynucleotides of between about 18 to about 200 or about 300 nucleotides (for single-stranded polynucleotides) or between about 18 to about 200 or about 300 base-pairs (for double-stranded polynucleotides). Alternatively the polynucleotide can be provided in more complex constructs, e. g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e. g., an insecticidal protein).

In various embodiments of the method, the contacting includes application to a surface of the *Diabrotica* species of a suitable composition including the polynucleotide; such a composition can be provided, e. g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix. The contacting can be in the form of a seed treatment. Suitable binders, inert carriers, surfactants, and the like can optionally be included in the composition, as is known to one skilled in formulation of pesticides and seed treatments. In embodiments, the contacting includes providing the polynucleotide in a composition that further includes one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator. In embodiments, the contacting includes providing the polynucleotide in a composition that further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein. In one embodiment the contacting includes providing the polynucleotide in a composition that can be ingested or otherwise absorbed internally by the *Diabrotica* species.

Methods of Selecting Target Genes

Another aspect of this invention provides a method of selecting preferred target genes for RNAi-mediated silencing. In an embodiment, the method provides a subset of target genes that are present in single- or low-copy-number (i. e., non-repetitive and non-redundant) in a particular genome. Such preferred target genes can be genes from a plant genome or genes from an animal genome. In embodiments, the preferred target genes are genes of an invertebrate pest, e. g. an invertebrate pest of a plant or an invertebrate pest of a vertebrate. In embodiments, the preferred target genes are genes of an insect pest of a plant or a nematode pest of a plant. In embodiments, the preferred target genes are genes of a *Diabrotica* species. Further aspects of this invention include manufacturing a polynucleotide of this invention (e. g., an ssRNA or dsRNA trigger, such as the dsRNA triggers described in the working Examples, or a recombinant DNA construct of this invention useful for making transgenic plants) based on preferred target genes for RNAi-mediated silencing selected by any of the methods described herein.

In an embodiment, the method includes the step of identifying single- or low-copy-number genes in the chosen genome, or alternatively to identify single- or low-copy-number genes in an orthologous database from related organisms to predict which genes will be single/low copy in the chosen organism. Low-copy genes, and in particular single-copy genes, are selected as preferred targets for RNAi-mediated silencing. In one embodiment, the identification of single- or low-copy-number genes is carried out by sequence comparison between a set of genes from a first species and a set of genes from a second species, wherein the set of genes from a second species have been identified as single- or low-copy-number in the second species. In one embodiment, the identification of single- or low-copy-number genes is carried out by applying an algorithm performed by a computer to a set of genes from a first species to identify a subset of single- or low-copy-number genes in the set of genes from the first species, then comparing a set of genes from a second species to the subset of single- or low-copy-number genes from the first species to identify corresponding single- or low-copy-number genes from the second species. The single- or low-copy-number genes from the second species are useful as preferred target genes for RNAi-mediated silencing; the sequences of these preferred target genes are used for designing polynucleotides (e. g., an ssRNA or dsRNA trigger, such as the dsRNA triggers described in the working Examples, or recombinant DNA constructs for making transgenic plants) and methods of use thereof for preventing or controlling infestations by the second species.

Embodiments of the method include a further step of estimating nucleotide diversity for low-/single-copy genes in a population of the chosen organism and selecting those low-/single-copy genes that further have the lowest nucleotide diversity. Low-/single-copy genes that further have low nucleotide diversity are selected as preferred targets for RNAi-mediated silencing.

Embodiments of the method include a further step of comparing the ratio of synonymous ($K_s$) to nonsynonymous ($K_a$) nucleotide changes as an estimate of functional or evolutionary constraint. In an embodiment, the method includes the step of selecting genes where $K_s$ is at least equal to or greater than $K_a$. In an embodiment, the method includes the step of selecting genes where $K_s >> K_a$.

A related aspect of this invention is a set of preferred target genes for RNAi-mediated silencing identified from a genome by any of the gene selection methods described herein. An embodiment includes a set of preferred target genes for RNAi-mediated silencing selected from a genome by identifying single- or low-copy-number target genes from a larger set of genes from that genome. One embodiment includes a set of preferred target genes for RNAi-mediated silencing selected from an invertebrate genome by identifying single- or low-copy-number target genes from a larger set of genes from that invertebrate genome. A specific embodiment includes a set of preferred target genes for RNAi-mediated silencing in a *Diabrotica* species selected from a *Diabrotica* genome by identifying single- or low-copy-number target genes from a larger set of genes from that *Diabrotica* genome.

Another embodiment includes a set of preferred target genes for RNAi-mediated silencing selected from a genome by estimating nucleotide diversity for a given set of genes in a population of individuals of the species having that genome, and selecting those genes that have the lowest nucleotide diversity. One embodiment includes a set of preferred target genes for RNAi-mediated silencing selected from an invertebrate genome by estimating nucleotide diversity for a given set of genes in a population of individuals of the invertebrate having that genome, and selecting those genes that have the lowest nucleotide diversity. Another embodiment includes a set of preferred target genes for RNAi-mediated silencing selected from an invertebrate genome by estimating nucleotide diversity for low-/single-copy genes in a population of individuals of the invertebrate having that genome, and selecting those low-/single-copy genes that further have the lowest nucleotide diversity.

Another embodiment includes a set of preferred target genes for RNAi-mediated silencing selected from a genome by comparing the ratio of synonymous ($K_s$) to nonsynonymous ($K_a$) nucleotide changes in genes of that genome and selecting genes where $K_s$ is at least equal to or greater than $K_a$. In an embodiment, the set of preferred target genes for RNAi-mediated silencing are genes where $K_a$ is at least equal to or greater than $K_a$. In an embodiment, the set of preferred target genes for RNAi-mediated silencing are genes where $K_s >> K_a$. An embodiment includes a set of preferred target genes for RNAi-mediated silencing selected from an invertebrate genome and where $K_s >> K_a$ for the selected genes.

In an embodiment, the single- or low-copy-number target genes are a subset of target genes of a first invertebrate species selected from a larger set of genes from the first invertebrate species, wherein the selection is by a sequence comparison performed by a computer between the larger set of genes from the first invertebrate species and a set of genes from a second invertebrate species that have been identified as single- or low-copy-number in the second invertebrate species. In a specific embodiment, the single- or low-copy-number target genes are a subset of *Diabrotica virgifera virgifera* target genes selected from a larger set of *Diabrotica virgifera virgifera* target genes, wherein the selection is by a sequence comparison performed by a computer between the larger set of *Diabrotica virgifera virgifera* target genes and a set of genes from a second invertebrate species that have been identified as single- or low-copy-number in the second invertebrate species. The preferred *Diabrotica virgifera virgifera* single- or low-copy-number target genes selected by the method are particularly useful in making polynucleotides of this invention, including recombinant DNA constructs useful, e. g., for providing plants having increased resistance to a *Diabrotica* species infestation, and isolated recombinant RNA molecules useful, e. g., in making compositions for topical treatment of a plant or *Diabrotica* species to provide prevention or control of a *Diabrotica* species infestations. In an embodiment, preferred *Diabrotica virgifera virgifera* single- or low-copy-number target genes selected by the method are genes having a sequence selected from the group consisting of SEQ ID NOs:1-450.

A further aspect of this invention are polyclonal or monoclonal antibodies that bind a protein encoded by a sequence or a fragment of a sequence selected from the group consisting of SEQ ID NOs:1-450; such antibodies are made by routine methods as known to one of ordinary skill in the art, for example using routine protocols as described in "Antibody Methods and Protocols" (Proetzel and Ebersbach, editors, 2012, Humana Press, New York) or "Making and Using Antibodies" (Howard and Kaser, editors, 2006, CRC Press, Boca Raton).

Related Techniques

Embodiments of the polynucleotides and nucleic acid molecules of this invention can include additional elements, such as promoters, small RNA recognition sites, aptamers or ribozymes, additional and additional expression cassettes for expressing coding sequences (e. g., to express a transgene such as an insecticidal protein or selectable marker) or non-coding sequences (e. g., to express additional suppression elements). For example, an aspect of this invention provides a recombinant DNA construct including a heterologous promoter operably linked to DNA including at least one segment of 18 or more contiguous nucleotides with a sequence of about 95% to about 100% identity with a segment of equivalent length of a DNA having a sequence selected from the group consisting of SEQ ID NOs:1-450 or the DNA complement thereof. In another embodiment, a recombinant DNA construct including a promoter operably linked to DNA encoding: (a) an RNA silencing element for suppressing a target gene selected from the group consisting of the genes identified in Table 1), and (b) an aptamer, is stably integrated into the plant's genome from where RNA transcripts including the RNA aptamer and the RNA silencing element are expressed in cells of the plant; the aptamer serves to guide the RNA silencing element to a desired location in the cell. In another embodiment, inclusion of one or more recognition sites for binding and cleavage by a small RNA (e. g., by a miRNA or an siRNA that is expressed only in a particular cell or tissue) allows for more precise expression patterns in a plant, wherein the expression of the recombinant DNA construct is suppressed where the small RNA is expressed. Such additional elements are described below.

Promoters

Promoters of use in the invention are functional in the cell in which the construct is intended to be transcribed. Generally these promoters are heterologous promoters, as used in recombinant constructs, i. e., they are not in nature found to be operably linked to the other nucleic elements used in the constructs of this invention. In various embodiments, the promoter is selected from the group consisting of a constitutive promoter, a spatially specific promoter, a temporally specific promoter, a developmentally specific promoter, and an inducible promoter. In many embodiments the promoter is a promoter functional in a plant, for example, a pol II promoter, a pol III promoter, a pol IV promoter, or a pol V promoter.

Non-constitutive promoters suitable for use with the recombinant DNA constructs of this invention include spatially specific promoters, temporally specific promoters, and inducible promoters. Spatially specific promoters can include organelle-, cell-, tissue-, or organ-specific promoters (e. g., a plastid-specific, a root-specific, a pollen-specific, or a seed-specific promoter for expression in plastids, roots, pollen, or seeds, respectively). In many cases a seed-specific, embryo-specific, aleurone-specific, or endosperm-specific promoter is especially useful. Temporally specific promoters can include promoters that tend to promote expression during certain developmental stages in a plant's growth cycle, or during different times of day or night, or at different seasons in a year. Inducible promoters include promoters induced by chemicals or by environmental conditions such as, but not limited to, biotic or abiotic stress (e. g., water deficit or drought, heat, cold, high or low nutrient or salt levels, high or low light levels, or pest or pathogen infection). MicroRNA promoters are useful, especially those having a temporally specific, spatially specific, or inducible expression pattern; examples of miRNA promoters, as well as methods for identifying miRNA promoters having specific expression patterns, are provided in U. S. Patent Application Publications 2006/0200878, 2007/0199095, and 2007/0300329, which are specifically incorporated herein by reference. An expression-specific promoter can also include promoters that are generally constitutively expressed but at differing degrees or "strengths" of expression, including promoters commonly regarded as "strong promoters" or as "weak promoters".

Promoters of particular interest include the following examples: an opaline synthase promoter isolated from T-DNA of Agrobacterium; a cauliflower mosaic virus 35S promoter; enhanced promoter elements or chimeric promoter elements such as an enhanced cauliflower mosaic virus (CaMV) 35S promoter linked to an enhancer element (an intron from heat shock protein 70 of Zea mays); root specific promoters such as those disclosed in U.S. Pat. Nos. 5,837,848; 6,437,217 and 6,426,446; a maize L3 oleosin promoter disclosed in U.S. Pat. No. 6,433,252; a promoter for a plant nuclear gene encoding a plastid-localized aldolase disclosed in U. S. Patent Application Publication 2004/0216189; cold-inducible promoters disclosed in U.S. Pat. No. 6,084,089; salt-inducible promoters disclosed in U.S. Pat. No. 6,140,078; light-inducible promoters disclosed in U.S. Pat. No. 6,294,714; pathogen-inducible promoters disclosed in U.S. Pat. No. 6,252,138; and water deficit-inducible promoters disclosed in U.S. Patent Application Publication 2004/0123347 A1. All of the above-described patents and patent publications disclosing promoters and their use, especially in recombinant DNA constructs functional in plants are incorporated herein by reference.

Plant vascular- or phloem-specific promoters of interest include a rolC or rolA promoter of Agrobacterium rhizogenes, a promoter of a Agrobacterium tumefaciens T-DNA gene 5, the rice sucrose synthase RSs1 gene promoter, a Commelina yellow mottle badnavirus promoter, a coconut foliar decay virus promoter, a rice tungro bacilliform virus promoter, the promoter of a pea glutamine synthase GS3A gene, a invCD111 and invCD141 promoters of a potato invertase genes, a promoter isolated from Arabidopsis shown to have phloem-specific expression in tobacco by Kertbundit et al. (1991) Proc. Natl. Acad. Sci. USA., 88:5212-5216, a VAHOX1 promoter region, a pea cell wall invertase gene promoter, an acid invertase gene promoter from carrot, a promoter of a sulfate transporter gene Sultr1; 3, a promoter of a plant sucrose synthase gene, and a promoter of a plant sucrose transporter gene.

Promoters suitable for use with a recombinant DNA construct or polynucleotide of this invention include polymerase II ("pol II") promoters and polymerase III ("pol III") promoters. RNA polymerase II transcribes structural or catalytic RNAs that are usually shorter than 400 nucleotides in length, and recognizes a simple run of T residues as a termination signal; it has been used to transcribe siRNA duplexes (see, e. g., Lu et al. (2004) Nucleic Acids Res., 32:e171). Pol II promoters are therefore preferred in certain embodiments where a short RNA transcript is to be produced from a recombinant DNA construct of this invention. In one embodiment, the recombinant DNA construct includes a pol II promoter to express an RNA transcript flanked by self-cleaving ribozyme sequences (e. g., self-cleaving hammerhead ribozymes), resulting in a processed RNA, such as a single-stranded RNA that binds to the transcript of the Diabrotica target gene, with defined 5' and 3' ends, free of potentially interfering flanking sequences. An alternative approach uses pol III promoters to generate transcripts with relatively defined 5' and 3' ends, i. e., to transcribe an RNA with minimal 5' and 3' flanking sequences. In some embodiments, Pol III promoters (e. g., U6 or H1 promoters) are preferred for adding a short AT-rich transcription termination site that results in 2 base-pair overhangs (UU) in the transcribed RNA; this is useful, e. g., for expression of siRNA-type constructs. Use of pol III promoters for driving expression of siRNA constructs has been reported; see van de Wetering et al. (2003) EMBO Rep., 4: 609-615, and Tuschl (2002) Nature Biotechnol., 20: 446-448.

The promoter element can include nucleic acid sequences that are not naturally occurring promoters or promoter elements or homologues thereof but that can regulate expression of a gene. Examples of such "gene independent" regulatory sequences include naturally occurring or artificially designed RNA sequences that include a ligand-binding region or aptamer (see "Aptamers", below) and a regulatory region (which can be cis-acting). See, for example, Isaacs et al. (2004) Nat. Biotechnol., 22:841-847, Bayer and Smolke (2005) Nature Biotechnol., 23:337-343, Mandal and Breaker (2004) Nature Rev. Mol. Cell Biol., 5:451-463, Davidson and Ellington (2005) Trends Biotechnol., 23:109-112, Winkler et al. (2002) Nature, 419:952-956, Sudarsan et al. (2003) RNA, 9:644-647, and Mandal and Breaker (2004) Nature Struct. Mol. Biol., 11:29-35. Such "riboregulators"

could be selected or designed for specific spatial or temporal specificity, for example, to regulate translation of DNA that encodes a silencing element for suppressing a *Diabrotica* target gene only in the presence (or absence) of a given concentration of the appropriate ligand. One example is a riboregulator that is responsive to an endogenous ligand (e. g., jasmonic acid or salicylic acid) produced by the plant when under stress (e. g., abiotic stress such as water, temperature, or nutrient stress, or biotic stress such as attach by pests or pathogens); under stress, the level of endogenous ligand increases to a level sufficient for the riboregulator to begin transcription of the DNA that encodes a silencing element for suppressing a *Diabrotica* target gene.

Recombinase Sites

In some embodiments, the recombinant DNA construct or polynucleotide of this invention includes DNA encoding one or more site-specific recombinase recognition sites. In one embodiment, the recombinant DNA construct includes at least a pair of loxP sites, wherein site-specific recombination of DNA between the loxP sites is mediated by a Cre recombinase. The position and relative orientation of the loxP sites is selected to achieve the desired recombination; for example, when the loxP sites are in the same orientation, the DNA between the loxP sites is excised in circular form. In another embodiment, the recombinant DNA construct includes DNA encoding one loxP site; in the presence of Cre recombinase and another DNA with a loxP site, the two DNAs are recombined.

Aptamers

In some embodiments, the recombinant DNA construct or polynucleotide of this invention includes DNA that is processed to an RNA aptamer, that is, an RNA that binds to a ligand through binding mechanism that is not primarily based on Watson-Crick base-pairing (in contrast, for example, to the base-pairing that occurs between complementary, anti-parallel nucleic acid strands to form a double-stranded nucleic acid structure). See, for example, Ellington and Szostak (1990) *Nature,* 346:818-822. Examples of aptamers can be found, for example, in the public Aptamer Database, available on line at aptamer.icmb.utexas.edu (Lee et al. (2004) *Nucleic Acids Res.,* 32(1):D95-100). Aptamers useful in the invention can, however, be monovalent (binding a single ligand) or multivalent (binding more than one individual ligand, e. g., binding one unit of two or more different ligands).

Ligands useful in the invention include any molecule (or part of a molecule) that can be recognized and be bound by a nucleic acid secondary structure by a mechanism not primarily based on Watson-Crick base pairing. In this way, the recognition and binding of ligand and aptamer is analogous to that of antigen and antibody, or of biological effector and receptor. Ligands can include single molecules (or part of a molecule), or a combination of two or more molecules (or parts of a molecule), and can include one or more macromolecular complexes (e. g., polymers, lipid bilayers, liposomes, cellular membranes or other cellular structures, or cell surfaces). Examples of specific ligands include vitamins such as coenzyme $B_{12}$ and thiamine pyrophosphate, flavin mononucleotide, guanine, adenosine, S-adenosylmethionine, S-adenosylhomocysteine, coenzyme A, lysine, tyrosine, dopamine, glucosamine-6-phosphate, caffeine, theophylline, antibiotics such as chloramphenicol and neomycin, herbicides such as glyphosate and dicamba, proteins including viral or phage coat proteins and invertebrate epidermal or digestive tract surface proteins, and RNAs including viral RNA, transfer-RNAs (t-RNAs), ribosomal RNA (rRNA), and RNA polymerases such as RNA-dependent RNA polymerase (RdRP). One class of RNA aptamers useful in the invention are "thermoswitches" that do not bind a ligand but are thermally responsive, that is to say, the aptamer's conformation is determined by temperature; see, for example, Box 3 in Mandal and Breaker (2004) *Nature Rev. Mol. Cell Biol.,* 5:451-463.

Transgene Transcription Units

In some embodiments, the recombinant DNA construct or polynucleotide of this invention includes a transgene transcription unit. A transgene transcription unit includes DNA sequence encoding a gene of interest, e. g., a natural protein or a heterologous protein. A gene of interest can be any coding or non-coding sequence from any species (including, but not limited to, non-eukaryotes such as bacteria, and viruses; fungi, protists, plants, invertebrates, and vertebrates. Particular genes of interest are genes encoding at least one pesticidal agent selected from the group consisting of a patatin, a plant lectin, a phytoecdysteroid, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein. The transgene transcription unit can further include 5' or 3' sequence or both as required for transcription of the transgene.

Introns

In some embodiments, the recombinant DNA construct or polynucleotide of this invention includes DNA encoding a spliceable intron. By "intron" is generally meant a segment of DNA (or the RNA transcribed from such a segment) that is located between exons (protein-encoding segments of the DNA or corresponding transcribed RNA), wherein, during maturation of the messenger RNA, the intron present is enzymatically "spliced out" or removed from the RNA strand by a cleavage/ligation process that occurs in the nucleus in eukaryotes. The term "intron" is also applied to non-coding DNA sequences that are transcribed to RNA segments that can be spliced out of a maturing RNA transcript, but are not introns found between protein-coding exons. One example of these are spliceable sequences that that have the ability to enhance expression in plants (in some cases, especially in monocots) of a downstream coding sequence; these spliceable sequences are naturally located in the 5' untranslated region of some plant genes, as well as in some viral genes (e. g., the tobacco mosaic virus 5' leader sequence or "omega" leader described as enhancing expression in plant genes by Gallie and Walbot (1992) *Nucleic Acids Res.,* 20:4631-4638). These spliceable sequences or "expression-enhancing introns" can be artificially inserted in the 5' untranslated region of a plant gene between the promoter but before any protein-coding exons. Examples of such expression-enhancing introns include, but are not limited to, a maize alcohol dehydrogenase (Zm-Adh1), a maize Bronze-1 expression-enhancing intron, a rice actin 1 (Os-Act1) intron, a Shrunken-1 (Sh-1) intron, a maize sucrose synthase intron, a heat shock protein 18 (hsp18) intron, and an 82 kilodalton heat shock protein (hsp82) intron. U.S. Pat. Nos. 5,593,874 and 5,859,347, specifically incorporated by reference herein, describe methods of improving recombinant DNA constructs for use in plants by inclusion of an expression-enhancing intron derived from the 70 kilodalton maize heat shock protein (hsp70) in the non-translated leader positioned 3' from the gene promoter and 5' from the first protein-coding exon.

Ribozymes

In some embodiments, the recombinant DNA construct or polynucleotide of this invention includes DNA encoding one or more ribozymes. Ribozymes of particular interest include a self-cleaving ribozyme, a hammerhead ribozyme, or a hairpin ribozyme. In one embodiment, the recombinant DNA construct includes DNA encoding one or more ribozymes that serve to cleave the transcribed RNA to provide defined segments of RNA, such as silencing elements for suppressing a *Diabrotica* target gene.

Gene Suppression Elements

In some embodiments, the recombinant DNA construct or polynucleotide of this invention includes DNA encoding an additional gene suppression element for suppressing a target gene other than a *Diabrotica* target gene. The target gene to be suppressed can include coding or non-coding sequence or both.

Suitable gene suppression elements are described in detail in U. S. Patent Application Publication 2006/0200878, which disclosure is specifically incorporated herein by reference, and include one or more of:
  (a) DNA that includes at least one anti-sense DNA segment that is anti-sense to at least one segment of the gene to be suppressed;
  (b) DNA that includes multiple copies of at least one anti-sense DNA segment that is anti-sense to at least one segment of the gene to be suppressed;
  (c) DNA that includes at least one sense DNA segment that is at least one segment of the gene to be suppressed;
  (d) DNA that includes multiple copies of at least one sense DNA segment that is at least one segment of the gene to be suppressed;
  (e) DNA that transcribes to RNA for suppressing the gene to be suppressed by forming double-stranded RNA and includes at least one anti-sense DNA segment that is anti-sense to at least one segment of the gene to be suppressed and at least one sense DNA segment that is at least one segment of the gene to be suppressed;
  (f) DNA that transcribes to RNA for suppressing the gene to be suppressed by forming a single double-stranded RNA and includes multiple serial anti-sense DNA segments that are anti-sense to at least one segment of the gene to be suppressed and multiple serial sense DNA segments that are at least one segment of the gene to be suppressed;
  (g) DNA that transcribes to RNA for suppressing the gene to be suppressed by forming multiple double strands of RNA and includes multiple anti-sense DNA segments that are anti-sense to at least one segment of the gene to be suppressed and multiple sense DNA segments that are at least one segment of the gene to be suppressed, and wherein the multiple anti-sense DNA segments and the multiple sense DNA segments are arranged in a series of inverted repeats;
  (h) DNA that includes nucleotides derived from a plant miRNA;
  (i) DNA that includes nucleotides of a siRNA;
  (j) DNA that transcribes to an RNA aptamer capable of binding to a ligand; and
  (k) DNA that transcribes to an RNA aptamer capable of binding to a ligand, and DNA that transcribes to regulatory RNA capable of regulating expression of the gene to be suppressed, wherein the regulation is dependent on the conformation of the regulatory RNA, and the conformation of the regulatory RNA is allosterically affected by the binding state of the RNA aptamer.

In some embodiments, an intron is used to deliver a gene suppression element in the absence of any protein-coding exons (coding sequence). In one example, an intron, such as an expression-enhancing intron (preferred in certain embodiments), is interrupted by embedding within the intron a gene suppression element, wherein, upon transcription, the gene suppression element is excised from the intron. Thus, protein-coding exons are not required to provide the gene suppressing function of the recombinant DNA constructs disclosed herein.

Transcription Regulatory Elements

In some embodiments, the recombinant DNA construct or polynucleotide of this invention includes DNA encoding a transcription regulatory element. Transcription regulatory elements include elements that regulate the expression level of the recombinant DNA construct of this invention (relative to its expression in the absence of such regulatory elements). Examples of suitable transcription regulatory elements include riboswitches (cis- or trans-acting), transcript stabilizing sequences, and miRNA recognition sites, as described in detail in U. S. Patent Application Publication 2006/0200878, specifically incorporated herein by reference.

Making and Using Transgenic Plant Cells and Transgenic Plants

Transformation of a plant can include any of several well-known methods and compositions. Suitable methods for plant transformation include virtually any method by which DNA can be introduced into a cell. One method of plant transformation is microprojectile bombardment, for example, as illustrated in U.S. Pat. No. 5,015,580 (soybean), U.S. Pat. No. 5,538,880 (maize), U.S. Pat. No. 5,550,318 (maize), U.S. Pat. No. 5,914,451 (soybean), U.S. Pat. No. 6,153,812 (wheat), U.S. Pat. No. 6,160,208 (maize), U.S. Pat. No. 6,288,312 (rice), U.S. Pat. No. 6,365,807 (rice), and U.S. Pat. No. 6,399,861 (maize), and U.S. Pat. No. 6,403,865 (maize), all of which are incorporated by reference for enabling the production of transgenic plants.

Another useful method of plant transformation is *Agrobacterium*-mediated transformation by means of *Agrobacterium* containing a binary Ti plasmid system, wherein the *Agrobacterium* carries a first Ti plasmid and a second, chimeric plasmid containing at least one T-DNA border of a wild-type Ti plasmid, a promoter functional in the transformed plant cell and operably linked to a polynucleotide or recombinant DNA construct of this invention. See, for example, the binary system described in U.S. Pat. No. 5,159,135, incorporated by reference. Also see De Framond (1983) *Biotechnology*, 1:262-269; and Hoekema et al., (1983) *Nature*, 303:179. In such a binary system, the smaller plasmid, containing the T-DNA border or borders, can be conveniently constructed and manipulated in a suitable alternative host, such as *E. coli*, and then transferred into *Agrobacterium*.

Detailed procedures for *Agrobacterium*-mediated transformation of plants, especially crop plants, include procedures disclosed in U.S. Pat. Nos. 5,004,863, 5,159,135, and 5,518,908 (cotton); U.S. Pat. Nos. 5,416,011, 5,569,834, 5,824,877 and 6,384,301 (soybean); U.S. Pat. Nos. 5,591,616 and 5,981,840 (maize); U.S. Pat. No. 5,463,174 (brassicas including canola), U.S. Pat. No. 7,026,528 (wheat), and U.S. Pat. No. 6,329,571 (rice), and in U. S. Patent Application Publications 2004/0244075 (maize) and 2001/0042257 A1 (sugar beet), all of which are specifically incorporated by reference for enabling the production of transgenic plants. U. S. Patent Application Publication 2011/0296555 discloses in Example 5 the transformation vectors (including the vector sequences) and detailed protocols for transforming maize, soybean, canola, cotton, and sugarcane) and is specifically incorporated by reference for enabling the production of transgenic plants. Similar methods have been reported for many plant species, both dicots and monocots, including, among others, peanut (Cheng et al. (1996) *Plant Cell Rep.*, 15: 653); asparagus (Bytebier et al. (1987) *Proc. Natl. Acad. Sci. U.S.A.*, 84:5345); barley (Wan and Lemaux (1994) *Plant Physiol.*, 104:37); rice (Toriyama et al. (1988) *Bio/Technology*, 6:10; Zhang et al. (1988) *Plant Cell Rep.*, 7:379; wheat (Vasil et al. (1992) *Bio/Technology*, 10:667; Becker et al. (1994) *Plant J.*, 5:299), alfalfa (Masoud et al. (1996) *Transgen. Res.*, 5:313); and tomato (Sun et al. (2006) *Plant Cell Physiol.*, 47:426-431). See also a description of vectors, transformation methods, and production of transformed *Arabidopsis thaliana* plants where transcription factors are constitutively expressed by a CaMV35S promoter, in U. S. Patent Application Publication 2003/0167537 A1, incorporated by reference. Various methods of transformation of other plant species are well known in the art, see, for example, the encyclopedic reference, "Compendium of Transgenic Crop Plants", edited by Chittaranjan Kole and Timothy C. Hall, Blackwell Publishing Ltd., 2008; ISBN 978-1-405-16924-0 (available electronically at mrw.interscience.wiley.com/emrw/9781405181099/hpt/toc), which describes transformation procedures for cereals and forage grasses (rice, maize, wheat, barley, oat, sorghum, pearl millet, finger millet, cool-season forage grasses, and bahiagrass), oilseed crops (soybean, oilseed brassicas, sunflower, peanut, flax, sesame, and safflower), legume grains and forages (common bean, cowpea, pea, faba bean, lentil, tepary bean, Asiatic beans, pigeonpea, vetch, chickpea, lupin, alfalfa, and clovers), temperate fruits and nuts (apple, pear, peach, plums, berry crops, cherries, grapes, olive, almond, and Persian walnut), tropical and subtropical fruits and nuts (citrus, grapefruit, banana and plantain, pineapple, papaya, mango, avocado, kiwifruit, passionfruit, and persimmon), vegetable crops (tomato, eggplant, peppers, vegetable brassicas, radish, carrot, cucurbits, alliums, asparagus, and leafy vegetables), sugar, tuber, and fiber crops (sugarcane, sugar beet, stevia, potato, sweet potato, cassava, and cotton), plantation crops, ornamentals, and turf grasses (tobacco, coffee, cocoa, tea, rubber tree, medicinal plants, ornamentals, and turf grasses), and forest tree species One of ordinary skill in the art has various transformation methodologies for production of stable transgenic plants.

Transformation methods to provide transgenic plant cells and transgenic plants containing stably integrated recombinant DNA are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos or parts of embryos, and gametic cells such as microspores, pollen, sperm, and egg cells. Any cell from which a fertile plant can be regenerated is contemplated as a useful recipient cell for practice of this invention. Callus can be initiated from various tissue sources, including, but not limited to, immature embryos or parts of embryos, seedling apical meristems, microspores, and the like. Those cells which are capable of proliferating as callus can serve as recipient cells for genetic transformation. Practical transformation methods and materials for making transgenic plants of this invention (e. g., various media and recipient target cells, transformation of immature embryos, and subsequent regeneration of fertile transgenic plants) are disclosed, for example, in U.S. Pat. Nos. 6,194,636 and 6,232,526 and U. S. Patent Application Publication 2004/0216189, which are specifically incorporated by reference.

In general transformation practice, DNA is introduced into only a small percentage of target cells in any one transformation experiment. Marker genes are generally used to provide an efficient system for identification of those cells that are stably transformed by receiving and integrating a transgenic DNA construct into their genomes. Preferred marker genes provide selective markers which confer resistance to a selective agent, such as an antibiotic or herbicide. Any of the antibiotics or herbicides to which a plant cell is resistant can be a useful agent for selection. Potentially transformed cells are exposed to the selective agent. In the population of surviving cells will be those cells where, generally, the resistance-conferring gene is integrated and expressed at sufficient levels to permit cell survival. Cells can be tested further to confirm stable integration of the recombinant DNA. Commonly used selective marker genes include those conferring resistance to antibiotics such as kanamycin or paromomycin (nptII), hygromycin B (aph IV) and gentamycin (aac3 and aacC4) or resistance to herbicides such as glufosinate (bar or pat) and glyphosate (EPSPS). Examples of useful selective marker genes and selection agents are illustrated in U.S. Pat. Nos. 5,550,318, 5,633,435, 5,780,708, and 6,118,047, all of which are specifically incorporated by reference. Screenable markers or reporters, such as markers that provide an ability to visually identify transformants can also be employed. Examples of useful screenable markers include, for example, a gene expressing a protein that produces a detectable color by acting on a chromogenic substrate (e. g., beta glucuronidase (GUS) (uidA) or luciferase (luc)) or that itself is detectable, such as green fluorescent protein (GFP) (gfp) or an immunogenic molecule. Those of skill in the art will recognize that many other useful markers or reporters are available for use.

Detecting or measuring transcription of a recombinant DNA construct in a transgenic plant cell can be achieved by any suitable method, including protein detection methods (e. g., western blots, ELISAs, and other immunochemical methods), measurements of enzymatic activity, or nucleic acid detection methods (e. g., Southern blots, northern blots, PCR, RT-PCR, fluorescent in situ hybridization).

Other suitable methods for detecting or measuring transcription in a plant cell of a recombinant polynucleotide of this invention targeting a *Diabrotica* species target gene include measurement of any other trait that is a direct or proxy indication of the level of expression of the target gene in the *Diabrotica* species, relative to the level of expression observed in the absence of the recombinant polynucleotide, e. g., growth rates, mortality rates, or reproductive or recruitment rates of the *Diabrotica* species, or measurements of injury (e. g., root injury) or yield loss in a plant or field of plants infested by the *Diabrotica* species. In general, suitable methods for detecting or measuring transcription in a plant cell of a recombinant polynucleotide of interest include, e. g., gross or microscopic morphological traits, growth rates, yield, reproductive or recruitment rates, resistance to pests or pathogens, or resistance to biotic or abiotic stress (e. g., water deficit stress, salt stress, nutrient stress, heat or cold stress). Such methods can use direct measurements of a phenotypic trait or proxy assays (e. g., in plants, these assays include plant part assays such as leaf or root assays to determine tolerance of abiotic stress). Such methods include direct measurements of resistance to an invertebrate pest or pathogen (e. g., damage to plant tissues) or proxy assays (e. g., plant yield assays, or bioassays such as the Western corn rootworm (*Diabrotica virgifera virgifera* LeConte) larval bioassay described in International Patent Application Publication WO2005/110068 A2 and U. S. Patent Application Publication US 2006/0021087 A1, specifically incorporated by reference, or the soybean cyst nematode bioassay described by Steeves et al. (2006) *Funct. Plant Biol.,* 33:991-999, wherein cysts per plant, cysts per gram root, eggs per plant, eggs per gram root, and eggs per cyst are measured.

The recombinant DNA constructs of this invention can be stacked with other recombinant DNA for imparting additional traits (e. g., in the case of transformed plants, traits including herbicide resistance, pest resistance, cold germination tolerance, water deficit tolerance, and the like) for example, by expressing or suppressing other genes. Constructs for coordinated decrease and increase of gene expression are disclosed in U.S. Patent Application Publication 2004/0126845 A1, specifically incorporated by reference.

Seeds of fertile transgenic plants can be harvested and used to grow progeny generations, including hybrid generations, of transgenic plants of this invention that include the recombinant DNA construct in their genome. Thus, in addition to direct transformation of a plant with a recombinant DNA construct of this invention, transgenic plants of this invention can be prepared by crossing a first plant having the recombinant DNA with a second plant lacking the construct. For example, the recombinant DNA can be introduced into a plant line that is amenable to transformation to produce a transgenic plant, which can be crossed with a second plant line to introgress the recombinant DNA into the resulting progeny. A transgenic plant of this invention can be crossed with a plant line having other recombinant DNA that confers one or more additional trait(s) (such as, but not limited to, herbicide resistance, pest or disease resistance, environmental stress resistance, modified nutrient content, and yield improvement) to produce progeny plants having recombinant DNA that confers both the desired target sequence expression behavior and the additional trait(s).

In such breeding for combining traits the transgenic plant donating the additional trait can be a male line (pollinator) and the transgenic plant carrying the base traits can be the female line. The progeny of this cross segregate such that some of the plant will carry the DNA for both parental traits and some will carry DNA for one parental trait; such plants can be identified by markers associated with parental recombinant DNA Progeny plants carrying DNA for both parental traits can be crossed back into the female parent line multiple times, e. g., usually 6 to 8 generations, to produce a homozygous progeny plant with substantially the same genotype as one original transgenic parental line as well as the recombinant DNA of the other transgenic parental line.

Yet another aspect of this invention is a transgenic plant grown from the transgenic seed of this invention. This invention contemplates transgenic plants grown directly from transgenic seed containing the recombinant DNA as well as progeny generations of plants, including inbred or hybrid plant lines, made by crossing a transgenic plant grown directly from transgenic seed to a second plant not grown from the same transgenic seed. Crossing can include, for example, the following steps:
 (a) plant seeds of the first parent plant (e. g., non-transgenic or a transgenic) and a second parent plant that is transgenic according to the invention;
 (b) grow the seeds of the first and second parent plants into plants that bear flowers;
 (c) pollinate a flower from the first parent with pollen from the second parent; and
 (d) harvest seeds produced on the parent plant bearing the fertilized flower.

It is often desirable to introgress recombinant DNA into elite varieties, e. g., by backcrossing, to transfer a specific desirable trait from one source to an inbred or other plant that lacks that trait. This can be accomplished, for example, by first crossing a superior inbred ("A") (recurrent parent) to a donor inbred ("B") (non-recurrent parent), which carries the appropriate gene(s) for the trait in question, for example, a construct prepared in accordance with the current invention. The progeny of this cross first are selected in the resultant progeny for the desired trait to be transferred from the non-recurrent parent "B", and then the selected progeny are mated back to the superior recurrent parent "A". After five or more backcross generations with selection for the desired trait, the progeny can be essentially hemizygous for loci controlling the characteristic being transferred, but are like the superior parent for most or almost all other genes. The last backcross generation would be selfed to give progeny which are pure breeding for the gene(s) being transferred, i. e., one or more transformation events.

Through a series of breeding manipulations, a selected DNA construct can be moved from one line into an entirely different line without the need for further recombinant manipulation. One can thus produce inbred plants which are true breeding for one or more DNA constructs. By crossing different inbred plants, one can produce a large number of different hybrids with different combinations of DNA constructs. In this way, plants can be produced which have the desirable agronomic properties frequently associated with hybrids ("hybrid vigor"), as well as the desirable characteristics imparted by one or more DNA constructs.

In certain transgenic plant cells and transgenic plants of this invention, it is sometimes desirable to concurrently express a gene of interest while also modulating expression of a *Diabrotica* target gene. Thus, in some embodiments, the transgenic plant contains recombinant DNA further including a gene expression element for expressing at least one gene of interest, and transcription of the recombinant DNA construct of this invention is preferably effected with concurrent transcription of the gene expression element.

In some embodiments, the recombinant DNA constructs of this invention can be transcribed in any plant cell or tissue or in a whole plant of any developmental stage. Transgenic plants can be derived from any monocot or dicot plant, such as, but not limited to, plants of commercial or agricultural interest, such as crop plants (especially crop plants used for human food or animal feed), wood- or pulp-producing trees, vegetable plants, fruit plants, and ornamental plants. Examples of plants of interest include grain crop plants (such as wheat, oat, barley, maize, rye, triticale, rice, millet, sorghum, quinoa, amaranth, and buckwheat); forage crop plants (such as forage grasses and forage dicots including alfalfa, vetch, clover, and the like); oilseed crop plants (such as cotton, safflower, sunflower, soybean, canola, rapeseed, flax, peanuts, and oil palm); tree nuts (such as walnut, cashew, hazelnut, pecan, almond, and the like); sugarcane, coconut, date palm, olive, sugarbeet, tea, and coffee; wood- or pulp-producing trees; vegetable crop plants such as legumes (for example, beans, peas, lentils, alfalfa, peanut), lettuce, asparagus, artichoke, celery, carrot, radish, the brassicas (for example, cabbages, kales, mustards, and other leafy brassicas, broccoli, cauliflower, Brussels sprouts, turnip, kohlrabi), edible cucurbits (for example, cucumbers, melons, summer squashes, winter squashes), edible alliums (for example, onions, garlic, leeks, shallots, chives), edible members of the Solanaceae (for example, tomatoes, eggplants, potatoes, peppers, groundcherries), and edible members of the Chenopodiaceae (for example, beet, chard, spinach, quinoa, amaranth); fruit crop plants such as apple, pear, citrus fruits (for example, orange, lime, lemon, grapefruit, and others), stone fruits (for example, apricot, peach, plum, nectarine), banana, pineapple, grape, kiwifruit, papaya, avocado, and berries; plants grown for biomass or biofuel (for example, *Miscanthus* grasses, switchgrass, jatropha, oil palm, eukaryotic microalgae such as *Botryococcus braunii*, *Chlorella* spp., and *Dunaliella* spp., and eukaryotic macroalgae such as *Gracilaria* spp., and *Sargassum* spp.); and ornamental plants including ornamental flowering plants, ornamental trees and shrubs, ornamental groundcovers, and ornamental grasses.

This invention also provides commodity products produced from a transgenic plant cell, plant, or seed of this invention, including, but not limited to, harvested leaves, roots, shoots, tubers, stems, fruits, seeds, or other parts of a plant, meals, oils, extracts, fermentation or digestion products, crushed or whole grains or seeds of a plant, or any food or non-food product including such commodity products produced from a transgenic plant cell, plant, or seed of this invention. The detection of one or more of nucleic acid sequences of the recombinant DNA constructs of this invention in one or more commodity or commodity products contemplated herein is de facto evidence that the commodity or commodity product contains or is derived from a transgenic plant cell, plant, or seed of this invention.

Generally a transgenic plant having in its genome a recombinant DNA construct of this invention exhibits increased resistance to a *Diabrotica* species infestation. In various embodiments, for example, where the transgenic plant expresses a recombinant DNA construct of this invention that is stacked with other recombinant DNA for imparting additional traits, the transgenic plant has at least one additional altered trait, relative to a plant lacking the recombinant DNA construct, selected from the group of traits consisting of:

(a) improved abiotic stress tolerance;
(b) improved biotic stress tolerance;
(c) modified primary metabolite composition;
(d) modified secondary metabolite composition;
(e) modified trace element, carotenoid, or vitamin composition;
(f) improved yield;
(g) improved ability to use nitrogen, phosphate, or other nutrients;
(h) modified agronomic characteristics;
(i) modified growth or reproductive characteristics; and
(j) improved harvest, storage, or processing quality.

In some embodiments, the transgenic plant is characterized by: improved tolerance of abiotic stress (e. g., tolerance of water deficit or drought, heat, cold, non-optimal nutrient or salt levels, non-optimal light levels) or of biotic stress (e. g., crowding, allelopathy, or wounding); by a modified primary metabolite (e. g., fatty acid, oil, amino acid, protein, sugar, or carbohydrate) composition; a modified secondary metabolite (e. g., alkaloids, terpenoids, polyketides, non-ribosomal peptides, and secondary metabolites of mixed biosynthetic origin) composition; a modified trace element (e. g., iron, zinc), carotenoid (e. g., beta-carotene, lycopene, lutein, zeaxanthin, or other carotenoids and xanthophylls), or vitamin (e. g., tocopherols) composition; improved yield (e. g., improved yield under non-stress conditions or improved yield under biotic or abiotic stress); improved ability to use nitrogen, phosphate, or other nutrients; modified agronomic characteristics (e. g., delayed ripening; delayed senescence; earlier or later maturity; improved shade tolerance; improved resistance to root or stalk lodging; improved resistance to "green snap" of stems; modified photoperiod response); modified growth or reproductive characteristics (e. g., intentional dwarfing; intentional male sterility, useful, e. g., in improved hybridization procedures; improved vegetative growth rate; improved germination; improved male or female fertility); improved harvest, storage, or processing quality (e. g., improved resistance to pests during storage, improved resistance to breakage, improved appeal to consumers); or any combination of these traits.

In another embodiment, transgenic seed, or seed produced by the transgenic plant, has modified primary metabolite (e. g., fatty acid, oil, amino acid, protein, sugar, or carbohydrate) composition, a modified secondary metabolite composition, a modified trace element, carotenoid, or vitamin composition, an improved harvest, storage, or processing quality, or a combination of these. In another embodiment, it can be desirable to change levels of native components of the transgenic plant or seed of a transgenic plant, for example, to decrease levels of an allergenic protein or glycoprotein or of a toxic metabolite.

Generally, screening a population of transgenic plants each regenerated from a transgenic plant cell is performed to identify transgenic plant cells that develop into transgenic plants having the desired trait. The transgenic plants are assayed to detect an enhanced trait, e. g., enhanced water use efficiency, enhanced cold tolerance, increased yield, enhanced nitrogen use efficiency, enhanced seed protein, and enhanced seed oil. Screening methods include direct screening for the trait in a greenhouse or field trial or screening for a surrogate trait. Such analyses are directed to detecting changes in the chemical composition, biomass, physiological properties, or morphology of the plant. Changes in chemical compositions such as nutritional composition of grain are detected by analysis of the seed composition and content of protein, free amino acids, oil, free fatty acids, starch, tocopherols, or other nutrients. Changes in growth or biomass characteristics are detected by measuring plant height, stem diameter, internode length, root and shoot dry weights, and (for grain-producing plants such as maize, rice, or wheat) ear or seed head length and diameter. Changes in physiological properties are identified by evaluating responses to stress conditions, e. g., assays under imposed stress conditions such as water deficit, nitrogen or phosphate deficiency, cold or hot growing conditions, pathogen or insect attack, light deficiency, or increased plant density. Other selection properties include days to pollen shed, days to silking in maize, leaf extension rate, chlorophyll content, leaf temperature, stand, seedling vigor, internode length, plant height, leaf number, leaf area, tittering, brace roots, staying green, stalk lodging, root lodging, plant health, fertility, green snap, and pest resistance. In addition, phenotypic characteristics of harvested seed can be evaluated; for example, in maize this can include the number of kernels per row on the ear, number of rows of kernels on the ear, kernel abortion, kernel weight, kernel size, kernel density and physical grain quality. The following illustrates examples of screening assays useful for identifying desired traits in maize plants. These can be readily adapted for screening other plants such as canola, cotton, and soybean either as hybrids or inbreds.

Transgenic maize plants having nitrogen use efficiency are identified by screening in fields with three levels of nitrogen fertilizer being applied, e. g., low level (0 pounds/acre), medium level (80 pounds/acre) and high level (180 pounds/acre). Plants with enhanced nitrogen use efficiency provide higher yield as compared to control plants.

Transgenic maize plants having enhanced yield are identified by screening the transgenic plants over multiple locations with plants grown under optimal production management practices and maximum weed and pest control. A useful target for improved yield is a 5% to 10% increase in yield as compared to yield produced by plants grown from seed for a control plant. Selection methods can be applied in multiple and diverse geographic locations and over one or more planting seasons to statistically distinguish yield improvement from natural environmental effects.

Transgenic maize plants having enhanced water use efficiency are identified by screening plants in an assay where water is withheld for period to induce stress followed by watering to revive the plants. For example, a useful selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

Transgenic maize plants having enhanced cold tolerance are identified by screening plants in a cold germination assay and/or a cold tolerance field trial. In a cold germination assay trays of transgenic and control seeds are placed in a dark growth chamber at 9.7 degrees Celsius for 24 days. Seeds having higher germination rates as compared to the control are identified as having enhanced cold tolerance. In a cold tolerance field trial plants with enhanced cold tolerance are identified from field planting at an earlier date than conventional spring planting for the field location. For example, seeds are planted into the ground around two weeks before local farmers begin to plant maize so that a significant cold stress is exerted onto the crop. As a control, seeds also are planted under local optimal planting conditions such that the crop has little or no exposure to cold condition. At each location, seeds are planted under both cold and normal conditions preferably with multiple repetitions per treatment.

EXAMPLES

Example 1

This example illustrates non-limiting embodiments of sequences useful as target genes for controlling *Diabrotica* species and for making compositions and plants of this invention, and describes identification of such DNA sequences from *Diabrotica virgifera virgifera*. It is recognized that analogous sequences can be obtained from any other *Diabrotica* species referred to hereinabove.

cDNA libraries were generated from mid-guts of *Diabrotica virgifera virgifera* (Western corn rootworm, WCR) third instar larvae reared on corn plants, as follows. Disinfected WCR eggs were suspended in a 0.1% (w/v) agar solution and dispensed into petri dishes containing 2% (w/v) agar and filter paper. The WCR eggs were incubated first at 20 degrees Celsius and 60% relative humidity ("RH") for 3 days and then at 25 degrees Celsius and 60% RH for 10 days. After 13 days of incubation, the eggs were washed from the dishes into sweater boxes containing soil (2 parts Metro-Mix 200:1 part Redi-Earth; steam-sterilized) and germinated corn mats, which were prepared by geminating corn seeds of Dekalb line DKC64-04 in sweater boxes containing germination paper wet with 1.0% (w/v) 3336F fungicide. Larvae were reared in sweater boxes in a growth chamber (25 degrees Celsius, 70% relative humidity, irrigated for 10 minutes every 2 days, and fertilized every 4 days). Third instar larvae were dissected to separate mid-guts from other body parts (cuticle, head, fore- and hind-gut, and fat body). The harvested mid-guts were placed in chilled microcentrifuge tubes with 25 millimolar Tris buffer (pH 7.4), thoroughly saturated with the buffer, and then centrifuged for 5 minutes at 14,000 g at 4 degrees Celsius. The supernatant was discarded and mid-gut pellets were immediately frozen in liquid nitrogen and stored at −80 degrees Celsius until used for total RNA preparation. Total RNA was purified, from which the cDNA library was obtained by high-throughput sequencing using commercially available 454 technology (454 Life Sciences, 15 Commercial St., Branford, Conn. 06405, USA), as described in Margulies et al. (2005) *Nature*, 437:376-380. This provided approximately 1.27 million ~300 base-pair reads, which were supplemented with 17,800 publicly available ~520 base-pair Sanger reads from NCBI. The combined sequence data were assembled into contigs de novo using the Newbler (version 2.3) software package (454 Life Sciences, 15 Commercial St., Branford, Conn. 06405, USA). Approximately 16,130 genes were identified from the assembled sequence data.

Example 2

This example illustrates a method for non-random selection of target genes. More specifically, this example illustrates a method of selecting a subset of target genes that are present in single- or low-copy-number (i. e., non-repetitive and non-redundant) in a particular genome.

In general the method includes the step of identifying single- or low-copy-number genes in the chosen genome, or alternatively to identify single- or low-copy-number genes in an orthologous database from related organisms to predict which genes will be single/low copy in the chosen organism. Low-copy genes, and in particular single-copy genes, are unlikely to have their function recapitulated by a paralogue, and are selected as preferred targets for RNAi-mediated silencing. In other words, such genes are likely to represent essential functions, making these genes preferred targets for RNAi-mediated silencing.

Embodiments of the method include a further step of estimating nucleotide diversity for low-/single-copy gene in a population of the chosen organism and selecting those low-/single-copy genes that further have the lowest nucleotide diversity. Low-/single-copy genes that further have low nucleotide diversity are selected as preferred targets for RNAi-mediated silencing. One advantage provided by this step is simplification of design of recombinant nucleotide sequences (e. g., recombinant dsRNA sequences) for silencing such genes, as the possibility of mismatches between the silencing polynucleotide and the target gene is decreased.

Embodiments of the method include a further step of comparing the ratio of synonymous ($K_s$) to nonsynonymous ($K_a$) nucleotide changes as an estimate of functional or evolutionary constraint. If mutation occurs at random, for a gene randomly made of all possible codons, $K_a$ is approximately 2 times greater than $K_s$, given the structure of the genetic code. For genes under strong functional constraints (i. e., those genes likely to decrease fitness of the source organism if gene functionality is lost), natural selection is expected to remove nonsynonymous changes from the population while tolerating synonymous ones, resulting in a shift of the observed substitutions toward $K_s > K_a$. Selection of target genes can therefore be improved by including an estimate of functional or evolutionary constraint by selecting genes where $K_s \gg K_a$.

In a non-limiting example of the method, a public database of orthologous genes, OrthoDB6 (available at cegg.unige.ch/orthodb6 and described in Waterhouse et al. (2012)

Nucleic Acids Res., PMID: 23180791) was filtered to select a subset of 450 genes that were single-copy in *Tribolium castaneum* (red flour beetle, a coleopteran species) as well as single-copy in all available arthropod genomes in the database (i.e., 33 other arthropod genomes available at the time this application is filed).

While *Diabrotica virgifera virgifera* is not included in the OrthoDB database, *Tribolium castaneum* is a coleopteran species and is therefore more closely related to *Diabrotica* species than to other species in the database, which makes it more likely that a single-copy gene present in the *Tribolium castaneum* genome database will also be a single-copy gene in the *Diabrotica virgifera virgifera* genome, at least for genes that have high sequence similarity in the two organisms. From the 16,130 sequence contigs obtained from the *Diabrotica virgifera virgifera* (Western corn rootworm, WCR) sequencing and assembly described in Example 1, a subset of 450 genes were identified using a translated nucleotide BLAST search (tblastx) as genes having high sequence similarity (significance or e-value of less than or equal to $1 \times 10^{-15}$) to the 450 single-copy *Tribolium castaneum* genes in the OrthoDB database.

For sequence annotation, SmartBlast annotation was performed by using NCBI's Blastall 2.2.21 software to search *Diabrotica virgifera virgifera* contigs against the publicly available uniref90.fasta database (ftp.uniprot.org/pub/databases/uniprot/current_release/uniref/uniref90/). The blast search was performed in blastx mode (translated *Diabrotica virgifera virgifera* nucleotide queries searched against the uniref90 protein database). Only blast hits with an e-value less than or equal to 9e-9 were retained. For each *Diabrotica virgifera virgifera* contig the description line from the uniref90 best hit was used as an annotation. When no SmartBlast hits were found, the sequence was subjected to a supplementary Pfam search. To accomplish this, the longest open reading frame (ORF) was identified for each *Diabrotica virgifera virgifera* contig and used to query the publicly available Pfam-A database (ftp.sanger.ac.uk/pub/databases/Pfam/current_release) using the publicly available HMMER 3.0 software package (hmmer.janelia.org/). *Diabrotica virgifera virgifera* contigs with a Pfam hit with an e-value less than or equal to 1e-5 were annotated with the protein family name and the Pfam identifier. *Diabrotica virgifera virgifera* contigs with no SmartBlast or Pfam hit were annotated as "novel protein".

The subset of 450 *Diabrotica virgifera virgifera* genes is provided in Table 1, with each gene annotated based on sequence similarity to *Tribolium castaneum* and/or OrthoDB sequences, or by conserved Pfam domains. For each *Diabrotica virgifera virgifera* gene, the corresponding *Tribolium castaneum* presumed homologous single-copy gene is also identified, together with the similarity e-value for each pair.

TABLE 1

| SEQ ID NO. | Annotation | *Tribolium* Gene Name from OrthoDB database | Blast E-value *Tribolium* Gene vs *Diabrotica* Unigene |
|---|---|---|---|
| 1 | Sorting nexin-6 | TC000458 | 0 |
| 2 | Alpha spectrin | TC000749 | 0 |
| 3 | Clathrin | TC015014 | 0 |
| 4 | Eukaryotic translation initiation factor 3 subunit, putative | TC012303 | 0 |
| 5 | Lipin | TC010029 | 0 |
| 6 | Phagocyte signaling-impaired protein | TC015420 | 0 |
| 7 | Coatomer subunit beta', putative | TC013867 | 0 |
| 8 | Ns1 binding protein | TC009594 | 0 |
| 9 | Eukaryotic translation initiation factor 3 subunit B | TC006009 | 0 |
| 10 | TTC27 protein | TC011547 | 0 |
| 11 | Lissencephaly-1 homolog | TC005496 | 0 |
| 12 | Wd-repeat protein | TC005722 | 0 |
| 13 | Glutaminyl-trna synthetase | TC000042 | 0 |
| 14 | Transcription factor 25 | TC030734 | 0 |
| 15 | Sphingosine-1-phosphate lyase | TC000875 | 0 |
| 16 | Cleft lip and palate transmembrane protein | TC008245 | 0 |
| 17 | Vesicle docking protein P115 | TC006352 | 0 |
| 18 | Glutaminase kidney isoform, mitochondrial | TC004628 | 0 |
| 19 | eukaryotic translation initiation factor 2A | TC013517 | 0 |
| 20 | T-complex protein 1 subunit delta | TC007791 | 0 |
| 21 | ATP-grasp enzyme-like protein | TC000357 | 0 |
| 22 | Fimbrin | TC001769 | 0 |
| 23 | Pyridoxal-dependent decarboxylase domain-containing protein 1 | TC005445 | 0 |
| 24 | Coatomer subunit delta (Fragment) | TC003020 | 0 |
| 25 | Putative phosphoglycerate kinase | TC015540 | 0 |
| 26 | Glycylpeptide N-tetradecanoyl-transferase 2 | TC015649 | 0 |
| 27 | Succinyl-CoA: 3-ketoacid-coenzyme A transferase 1, putative | TC011712 | 0 |
| 28 | Sly1 protein-like protein | TC007530 | 0 |
| 29 | Trifunctional enzyme beta subunit (Tp-beta) | TC008872 | 0 |
| 30 | Zgc:100980 | TC006359 | 0 |
| 31 | 26S proteasome non-ATPase regulatory subunit 3 | TC014286 | 0 |
| 32 | 26S proteasome non-ATPase regulatory subunit, putative | TC006260 | 0 |
| 33 | Pre-mRNA-processing factor 6 | TC005794 | 0 |
| 34 | Sodium-dependent phosphate transport protein 1, chloroplastic | TC015307 | 0 |
| 35 | Protein singed, putative | TC006673 | 0 |
| 36 | WD-repeat protein, putative | TC001051 | 3.00E−180 |
| 37 | Eukaryotic translation initiation factor 3 subunit H | TC014327 | 7.00E−180 |
| 38 | SWI/SNF-related matrix-associated actin-dependent regulator of chromatin subfamily D member 1 | TC012873 | 1.00E−179 |
| 39 | 26S proteasome non-ATPase regulatory subunit, putative | TC015728 | 1.00E−178 |
| 40 | Elongation factor 1-gamma | TC007229 | 2.00E−175 |
| 41 | Abhydrolase domain-containing protein 2 | TC009769 | 9.00E−171 |
| 42 | Transmembrane protein 184B | TC003325 | 9.00E−171 |
| 43 | Pelota | TC001682 | 3.00E−170 |
| 44 | DNA polymerase epsilon, catalytic subunit | TC009600 | 3.00E−170 |
| 45 | Polymerase delta-interacting protein 2 | TC014911 | 3.00E−167 |
| 46 | Methylthioribose-1-phosphate isomerase | TC002054 | 3.00E−166 |
| 47 | Chitobiosyldiphosphodolichol beta-mannosyl-transferase | TC003528 | 1.00E−164 |
| 48 | Failed axon connections protein, putative | TC000100 | 3.00E−163 |
| 49 | Dolichyl-diphosphooligosaccharide--protein glycosyltransferase 67 kDa subunit, putative | TC005188 | 2.00E−160 |
| 50 | Membrane-bound O-acyltransferase domain-containing protein 2 | TC030770 | 2.00E−158 |
| 51 | Coproporphyrinogen iii oxidase | TC000466 | 9.00E−158 |
| 52 | Mitochondrial sulfide quinone oxidoreductase | TC001316 | 8.00E−157 |
| 53 | Coiled-coil domain-containing protein 47, putative | TC005820 | 6.00E−153 |

TABLE 1-continued

| SEQ ID NO. | Annotation | Tribolium Gene Name from OrthoDB database | Blast E-value Tribolium Gene vs Diabrotica Unigene |
|---|---|---|---|
| 54 | Eukaryotic translation initiation factor 2 subunit 1 | TC010161 | 8.00E−151 |
| 55 | Branched chain alpha-keto acid dehydrogenase E1 beta subunit | TC000711 | 2.00E−150 |
| 56 | Zinc-type alcohol dehydrogenase-like protein C1773.06c | TC013567 | 1.00E−146 |
| 57 | Ef-hand protein nucb1 | TC003574 | 2.00E−145 |
| 58 | Cxpwmw03 | TC004703 | 3.00E−145 |
| 59 | Gerrochelatase, putative | TC014202 | 8.00E−145 |
| 60 | D-3-phosphoglycerate dehydrogenase | TC013082 | 1.00E−144 |
| 61 | Sphingosine-1-phosphate phosphatase 1 | TC012252 | 2.00E−144 |
| 62 | Delta-aminolevulinic acid dehydratase | TC009997 | 3.00E−143 |
| 63 | Apyrase | TC005356 | 3.00E−142 |
| 64 | NADH dehydrogenase (Ubiquinone) 1 alpha subcomplex, 10 | TC008030 | 4.00E−142 |
| 65 | CDK5 and ABL1 enzyme substrate 1 | TC013369 | 2.00E−140 |
| 66 | THO complex subunit 5-like protein | TC005538 | 6.00E−140 |
| 67 | WD repeat-containing protein 75 | TC003309 | 2.00E−139 |
| 68 | Oligopeptidase | TC010332 | 3.00E−137 |
| 69 | Sodium/bile acid cotransporter 7 | TC006130 | 6.00E−136 |
| 70 | DCN1-like protein 1 (Fragment) | TC013916 | 1.00E−133 |
| 71 | Zinc finger protein 330 homolog | TC007558 | 2.00E−133 |
| 72 | Microfibrillar-associated protein | TC000456 | 2.00E−132 |
| 73 | Proliferating cell nuclear antigen | TC008874 | 2.00E−132 |
| 74 | Solute carrier family 2, facilitated glucose transporter member 6 | TC015433 | 3.00E−132 |
| 75 | Prolyl 3-hydroxylase 2 | TC004700 | 8.00E−132 |
| 76 | 60S ribosomal protein L10, mitochondrial | TC014453 | 6.00E−130 |
| 77 | General transcription factor IIF subunit 2 | TC013555 | 1.00E−129 |
| 78 | Electron transfer flavoprotein subunit beta | TC008707 | 5.00E−129 |
| 79 | Zinc finger protein-like 1 | TC009067 | 3.00E−127 |
| 80 | COMPASS component SWD2, putative | TC014755 | 2.00E−126 |
| 81 | Protein phosphatase 2A, 59 kDa regulatory subunit B, putative | TC009266 | 1.00E−123 |
| 82 | Translation initiation factor eIF-2B subunit delta | TC008223 | 3.00E−123 |
| 83 | Nucleoporin seh1, putative | TC009902 | 2.00E−122 |
| 84 | Rho-associated protein kinase, putative | TC011950 | 9.00E−122 |
| 85 | Golgi resident protein GCP60 | TC007892 | 7.00E−120 |
| 86 | Coatomer subunit epsilon | TC001210 | 9.00E−120 |
| 87 | Suppressor of profilin 2 | TC000050 | 1.00E−119 |
| 88 | Nucleolar protein 10 | TC014492 | 1.00E−119 |
| 89 | CCR4-NOT transcription complex subunit 3 | TC002501 | 2.00E−118 |
| 90 | Nimrod B | TC011428 | 7.00E−118 |
| 91 | Probable splicing factor, arginine/serine-rich 7 | TC009171 | 2.00E−116 |
| 92 | Leo1-like protein; Pfam: PF04004 | TC013564 | 3.00E−116 |
| 93 | Vesicular mannose-binding lectin | TC012578 | 9.00E−116 |
| 94 | Two pore calcium channel protein 1 | TC015674 | 2.00E−115 |
| 95 | 39S ribosomal protein L2, mitochondrial | TC000434 | 6.00E−114 |
| 96 | Zinc transporter 9 | TC007348 | 9.00E−114 |
| 97 | Cmp-sialic acid transporter | TC007703 | 1.00E−113 |
| 98 | Sparc | TC000930 | 2.00E−112 |
| 99 | RGS-GAIP interacting protein GIPC | TC011711 | 3.00E−112 |
| 100 | CG6672 | TC015914 | 2.00E−110 |
| 101 | DDB1- and CUL4-associated factor 7 | TC012028 | 1.00E−109 |
| 102 | Deoxyhypusine synthase | TC002446 | 2.00E−109 |
| 103 | Ubiquitin domain-containing protein UBFD1 | TC003520 | 8.00E−109 |
| 104 | Sorting nexin-4 | TC000603 | 2.00E−108 |
| 105 | Probable GDP-mannose 4,6 dehydratase | TC011606 | 3.00E−108 |
| 106 | Lethal s1921 | TC006746 | 6.00E−107 |
| 107 | Cytochrome c-type heme lyase | TC011725 | 4.00E−105 |
| 108 | Vesicle-trafficking protein SEC22b | TC007954 | 5.00E−105 |
| 109 | Vacuolar-sorting protein SNF8 | TC007472 | 1.00E−103 |
| 110 | Protein rogdi | TC011795 | 1.00E−103 |
| 111 | Probable GDP-fucose transporter | TC012326 | 1.00E−101 |
| 112 | Slc39a9-prov protein | TC015133 | 3.00E−101 |
| 113 | Cysteine desulfurylase | TC014434 | 5.00E−101 |
| 114 | ZIP Zinc transporter; Pfam: PF02535 | TC003468 | 1.00E−100 |
| 115 | AN1-type zinc finger protein, putative | TC013251 | 1.00E−100 |
| 116 | Blastoderm specific protein 25D, putative | TC003516 | 4.00E−99 |
| 117 | Eukaryotic initiation factor 4E | TC012945 | 2.00E−95 |
| 118 | Lysophospholipase | TC011535 | 3.00E−95 |
| 119 | Protein Red | TC015452 | 3.00E−95 |
| 120 | ATP-dependent RNA helicase SUV3, mitochondrial | TC012348 | 6.00E−95 |
| 121 | Vacuolar protein sorting-associated protein 11-like protein | TC005586 | 9.00E−95 |
| 122 | Alpha-1,3-mannosyltransferase | TC013994 | 8.00E−94 |
| 123 | Tubulin-specific chaperone C | TC008402 | 2.00E−92 |
| 124 | A kinase anchor protein 10, mitochondrial | TC012804 | 2.00E−92 |
| 125 | Cop-coated vesicle membrane protein P24 | TC012624 | 3.00E−92 |
| 126 | Transcription initiation factor TFIID subunit 6 | TC013033 | 5.00E−92 |
| 127 | DnaJ-like protein subfamily C member 10 | TC000962 | 2.00E−91 |
| 128 | GTP cyclohydrolase 1 | TC010564 | 2.00E−91 |
| 129 | vesicle-mediated transport protein Vid24 | TC006738 | 3.00E−91 |
| 130 | Transmembrane emp24 domain-containing protein 2 | TC015633 | 5.00E−91 |
| 131 | Transmembrane protein 145 | TC003142 | 5.00E−91 |
| 132 | UDP-N-acetylglucosamine--dolichyl-phosphate N-acetyl-glucosaminephosphotransferase | TC007854 | 1.00E−90 |
| 133 | CG8290, isoform B | TC008388 | 2.00E−90 |
| 134 | Charged multivesicular body protein 2a | TC007124 | 3.00E−90 |
| 135 | Cappuccino | TC012258 | 3.00E−90 |
| 136 | Protein MAK16-like protein A | TC000795 | 1.00E−88 |
| 137 | CG5131 | TC003033 | 1.00E−88 |
| 138 | Protein LTV1-like protein | TC008848 | 3.00E−88 |
| 139 | RING finger and CHY zinc finger domain-containing protein 1 | TC009851 | 3.00E−88 |
| 140 | Aspartyl/asparaginyl beta-hydroxylase | TC001594 | 3.00E−88 |
| 141 | Presenilin sel-12 | TC010178 | 1.00E−87 |
| 142 | CG8108, isoform A | TC003237 | 2.00E−87 |
| 143 | NADH dehydrogenase | TC015022 | 3.00E−87 |
| 144 | CAAX prenyl protease 2 | TC008733 | 1.00E−86 |
| 145 | Adaptin ear-binding coat-associated protein 2 | TC011619 | 5.00E−86 |
| 146 | Integrator complex subunit 3 | TC002074 | 8.00E−86 |
| 147 | Actin-related protein 5 | TC009219 | 1.00E−85 |
| 148 | Etoposide-induced protein 2.4-like protein | TC008317 | 2.00E−85 |
| 149 | Leucine-rich repeat flightless-interacting protein, putative | TC012376 | 3.00E−85 |
| 150 | Tollip-like protein | TC007125 | 1.00E−84 |
| 151 | Complement component | TC010563 | 3.00E−84 |
| 152 | Protein tyrosine phosphatase prl | TC004794 | 5.00E−84 |
| 153 | StAR-related lipid transfer protein 7 | TC004819 | 5.00E−84 |
| 154 | ETS translocation variant 1 | TC030651 | 1.00E−83 |
| 155 | Peroxisomal biogenesis factor, putative | TC002842 | 3.00E−83 |
| 156 | Ribosomal protein L12e | TC010002 | 1.00E−82 |
| 157 | Cellular retinaldehyde-binding protein | TC005781 | 2.00E−82 |
| 158 | Switch-associated protein 70 | TC006709 | 2.00E−82 |
| 159 | Helicase with zinc finger protein domain helz, putative | TC003141 | 2.00E−82 |
| 160 | CG8315 | TC009150 | 3.00E−82 |

TABLE 1-continued

| SEQ ID NO. | Annotation | Tribolium Gene Name from OrthoDB database | Blast E-value Tribolium Gene vs Diabrotica Unigene |
|---|---|---|---|
| 161 | Sorting nexin | TC000739 | 3.00E−82 |
| 162 | WD repeat-containing protein SAZD | TC006390 | 3.00E−82 |
| 163 | Mannosyltransferase | TC005068 | 6.00E−82 |
| 164 | Prefoldin subunit 3 | TC001098 | 7.00E−82 |
| 165 | Mediator of RNA polymerase II transcription subunit 8 | TC009839 | 7.00E−82 |
| 166 | Nuclear distribution protein NUDC | TC015243 | 2.00E−81 |
| 167 | CG1812, isoform A | TC012393 | 2.00E−81 |
| 168 | Transmembrane BAX inhibitor motif-containing protein 4 | TC013429 | 3.00E−81 |
| 169 | Alkylated DNA repair protein alkB-like protein 6 | TC000790 | 5.00E−81 |
| 170 | Mitochondrial ribosomal protein, L45, putative | TC009023 | 5.00E−81 |
| 171 | Myb-binding protein 1A | TC015701 | 7.00E−81 |
| 172 | Protein LSM12-like protein | TC015064 | 9.00E−81 |
| 173 | Retrograde Golgi transport protein RGP1-like protein | TC009939 | 1.00E−80 |
| 174 | Glucosamine-6-phosphate N-acetyltransferase | TC009619 | 4.00E−80 |
| 175 | ATPase family AAA domain-containing protein 3 | TC014695 | 5.00E−80 |
| 176 | Tumor necrosis factor induced protein | TC004961 | 1.00E−79 |
| 177 | Zinc finger CCHC domain-containing protein 9 | TC005967 | 2.00E−79 |
| 178 | Prenylated Rab acceptor protein, putative | TC014897 | 2.00E−79 |
| 179 | Phd finger protein | TC006094 | 2.00E−79 |
| 180 | Mitochondrial ribosomal protein L17 | TC007726 | 4.00E−79 |
| 181 | cAMP-dependent protein kinase catalytic subunit, putative | TC009500 | 1.00E−78 |
| 182 | Tab2 | TC005952 | 1.00E−77 |
| 183 | Polyadenylation factor subunit, putative | TC001352 | 1.00E−77 |
| 184 | Vacuolar H+-ATPase v1 sector subunit E | TC010367 | 3.00E−77 |
| 185 | Methyltransferase-like protein 10 | TC003501 | 5.00E−77 |
| 186 | Dihydrofolate reductase | TC030670 | 3.00E−76 |
| 187 | tRNA (Guanine-N(7)-)-methyltransferase | TC012665 | 3.00E−76 |
| 188 | Thioredoxin-like protein 4A | TC007987 | 2.00E−75 |
| 189 | Flap endonuclease 1 | TC009261 | 2.00E−75 |
| 190 | 6-phosphogluconolactonase | TC005667 | 3.00E−75 |
| 191 | Mediator of RNA polymerase II transcription subunit 19 | TC011979 | 3.00E−75 |
| 192 | Putative microsomal signal peptidase 25 kD subunit | TC013119 | 6.00E−75 |
| 193 | RNA 3' terminal phosphate cyclase | TC002529 | 6.00E−75 |
| 194 | Ral guanine nucleotide dissociation stimulator-like 1 | TC003754 | 7.00E−75 |
| 195 | Cysteine-rich hydrophobic protein | TC012812 | 2.00E−74 |
| 196 | WW domain-binding protein 2 | TC005552 | 5.00E−74 |
| 197 | Ribosomal protein L21 | TC007932 | 5.00E−74 |
| 198 | CG8768 | TC003713 | 6.00E−74 |
| 199 | HEAT repeat containing 7A isoform 2 | TC010431 | 8.00E−74 |
| 200 | Peroxisomal biogenesis factor, putative | TC015168 | 2.00E−72 |
| 201 | Tumor protein D54-like | TC013379 | 5.00E−72 |
| 202 | Zinc finger CCCH domain-containing protein 15-like protein | TC000028 | 8.00E−72 |
| 203 | CG7864 | TC030620 | 9.00E−72 |
| 204 | WD repeat-containing protein 47 | TC001580 | 1.00E−71 |
| 205 | Galactose-1-phosphate uridylyltransferase | TC003858 | 2.00E−71 |
| 206 | fibroblast growth factor (acidic) intracellular binding protein | TC006041 | 1.00E−70 |
| 207 | Synaptic vesicle 2-related protein | TC003566 | 5.00E−70 |
| 208 | Coiled-coil protein, putative | TC001451 | 9.00E−70 |
| 209 | F1-ATPase chaperone | TC006560 | 1.00E−69 |
| 210 | NADH dehydrogenase, putative | TC006357 | 1.00E−69 |
| 211 | COP9 signalosome complex subunit, putative | TC030655 | 3.00E−69 |
| 212 | Arp2/3 complex 20 kD subunit, putative | TC015671 | 5.00E−69 |
| 213 | Elongator complex protein 2 (ELP2) (STAT3-interacting protein) (StIP1) (SHINC-2) | TC012601 | 1.00E−68 |
| 214 | ATP synthase mitochondrial F1 complex assembly factor 2 | TC013923 | 3.00E−68 |
| 215 | Nudt18 protein | TC004374 | 5.00E−68 |
| 216 | NADH: ubiquinone dehydrogenase, putative | TC015691 | 8.00E−68 |
| 217 | Membrin | TC013356 | 9.00E−68 |
| 218 | Mitochondrial ribosomal protein L11 | TC009555 | 2.00E−67 |
| 219 | Protein CLEC16A | TC005512 | 2.00E−67 |
| 220 | 15 kDa selenoprotein, putative | TC003269 | 5.00E−67 |
| 221 | 3110057O12Rik protein | TC010883 | 6.00E−67 |
| 222 | Zgc:123096 | TC009382 | 2.00E−66 |
| 223 | Methyltransferase-like protein 11A | TC013789 | 2.00E−66 |
| 224 | Def8 protein, putative | TC003420 | 2.00E−66 |
| 225 | Zinc finger CCCH domain-containing protein 11A | TC007327 | 6.00E−66 |
| 226 | Upstream activation factor subunit UAF30 | TC012018 | 9.00E−66 |
| 227 | Phosphatidylserine decarboxylase | TC004926 | 1.00E−65 |
| 228 | N-acetyltransferase 9-like protein | TC000126 | 1.00E−65 |
| 229 | Alkylated DNA repair protein alkB-like protein 1 | TC007602 | 3.00E−65 |
| 230 | TBC1 domain family | TC014792 | 3.00E−65 |
| 231 | CG4618 | TC005451 | 5.00E−65 |
| 232 | Exocyst complex component, putative | TC005817 | 5.00E−65 |
| 233 | Mediator of RNA polymerase II transcription subunit 6 | TC009982 | 1.00E−64 |
| 234 | Thioredoxin domain-containing protein 15 | TC005372 | 2.00E−64 |
| 235 | Gualynate kinase-1 (Fragment) | TC014210 | 3.00E−64 |
| 236 | KTI12 protein, putative | TC005882 | 3.00E−64 |
| 237 | Lymphoid-retricited membrane protein, jaw1, putative (Fragment) | TC007394 | 4.00E−64 |
| 238 | Methyltransferase-like protein 9 | TC003894 | 1.00E−63 |
| 239 | Novel protein | TC010150 | 2.00E−63 |
| 240 | Zinc finger FYVE domain-containing protein 19 | TC009615 | 2.00E−63 |
| 241 | Novel protein | TC015595 | 5.00E−63 |
| 242 | Protein FAM91A1 | TC004359 | 6.00E−63 |
| 243 | Protein enabled | TC002504 | 2.00E−62 |
| 244 | Cleavage and polyadenylation specificity factor subunit 6 | TC008014 | 3.00E−62 |
| 245 | Small GTPase, putative | TC013254 | 4.00E−62 |
| 246 | Multiprotein Bridging Factor 1 | TC000104 | 9.00E−62 |
| 247 | Myb-like protein; Pfam: PF13921 | TC008316 | 2.00E−61 |
| 248 | Protein midA homolog, mitochondrial | TC003565 | 3.00E−61 |
| 249 | Mitochondrial carnitine/acyl-carnitine carrier protein | TC012546 | 5.00E−61 |
| 250 | COMM domain-containing protein 2 | TC014257 | 7.00E−61 |
| 251 | Ribosomal protein L35A | TC002098 | 7.00E−61 |
| 252 | Coiled-coil domain-containing protein 93 | TC002495 | 1.00E−60 |
| 253 | Coiled-coil domain-containing protein MTMR15 | TC010140 | 2.00E−60 |
| 254 | Methylmalonic aciduria and homocystinuria type D protein, mitochondrial | TC000972 | 2.00E−60 |
| 255 | Rhomboid protein 1, mitochondrial | TC013516 | 3.00E−60 |
| 256 | Homocysteine-responsive endoplasmic reticulum-resident ubiquitin-like domain member 2 protein | TC010160 | 7.00E−60 |
| 257 | WH2 protein, Pfam: PF02205 | TC012341 | 8.00E−60 |
| 258 | WD repeat-containing protein 4 (fragment) | TC000064 | 1.00E−59 |
| 259 | Vacuolar protein sorting-associated protein 16-like protein | TC001384 | 2.00E−59 |

TABLE 1-continued

| SEQ ID NO. | Annotation | Tribolium Gene Name from OrthoDB database | Blast E-value Tribolium Gene vs Diabrotica Unigene |
|---|---|---|---|
| 260 | Arp2/3 complex 16 kD subunit, putative | TC013790 | 9.00E−59 |
| 261 | Novel protein | TC008531 | 1.00E−58 |
| 262 | Mapmodulin, putative | TC030635 | 2.00E−58 |
| 263 | Ensconsin, isoform E | TC010873 | 2.00E−58 |
| 264 | Casein kinase II subunit beta | TC000224 | 2.00E−58 |
| 265 | Prefoldin subunit 5 | TC011234 | 2.00E−58 |
| 266 | Deoxynucleotidyltransferase terminal-interacting protein 2 | TC000065 | 4.00E−58 |
| 267 | Golgin subfamily A member 5 | TC004294 | 7.00E−58 |
| 268 | Lethal neo18 | TC004388 | 4.00E−57 |
| 269 | Pyridoxal kinase | TC003259 | 4.00E−57 |
| 270 | Putative ARP-like | TC015785 | 7.00E−57 |
| 271 | Mitochondrial ribosomal protein L48 | TC007588 | 2.00E−56 |
| 272 | Splicing factor SPF30 | TC005331 | 3.00E−56 |
| 273 | Transmembrane protein 208 | TC003864 | 4.00E−56 |
| 274 | Novel protein | TC010006 | 5.00E−56 |
| 275 | NIF3-like protein 1 | TC011681 | 7.00E−56 |
| 276 | Neuroendocrine protein 7b2 | TC008457 | 2.00E−55 |
| 277 | Class I helical cytokine receptor member 2 | TC000209 | 2.00E−55 |
| 278 | CG8675 | TC002245 | 2.00E−55 |
| 279 | Novel protein | TC007222 | 3.00E−55 |
| 280 | Dolichyldiphosphatase, putative | TC013393 | 3.00E−55 |
| 281 | Low density lipoprotein receptor adapter protein 1 | TC006386 | 4.00E−55 |
| 282 | Formin-binding protein 4 | TC005008 | 5.00E−55 |
| 283 | BRCA1-A complex subunit MERIT40 | TC004528 | 9.00E−55 |
| 284 | Ribosomal protein L31 | TC008311 | 1.00E−54 |
| 285 | Reticulon; Pfam: PF02453 | TC011617 | 2.00E−54 |
| 286 | Circadian clock-controlled protein | TC013657 | 3.00E−54 |
| 287 | Ribosomal protein L28 | TC003255 | 5.00E−54 |
| 288 | Transmembrane domains-containing protein | TC003492 | 7.00E−54 |
| 289 | N-acetyltransferase MAK3-like protein | TC008129 | 2.00E−53 |
| 290 | N-acetyltransferase UNQ2771/PRO7155-like protein | TC010378 | 1.00E−52 |
| 291 | Protein rolling stone | TC005180 | 2.00E−52 |
| 292 | 39S ribosomal protein L32, mitochondrial | TC001148 | 2.00E−52 |
| 293 | Transcription initiation factor TFIID subunit 13 | TC001068 | 3.00E−52 |
| 294 | Phosphatidylcholine: ceramide cholinephosphotransferase 1 | TC006942 | 4.00E−52 |
| 295 | WD40 repeat protein | TC015135 | 5.00E−52 |
| 296 | Mitochondrial 39S ribosomal protein L27 | TC000079 | 5.00E−52 |
| 297 | TMEM9 domain family member B | TC002414 | 9.00E−52 |
| 298 | Novel protein | TC008970 | 1.00E−51 |
| 299 | Similar to poly(A)-specific ribonuclease, PARN | TC005425 | 1.00E−51 |
| 300 | Coiled-coil-helix-coiled-coil-helix domain-containing protein, putative | TC002433 | 2.00E−51 |
| 301 | Mitochondrial ribosomal protein, S23, putative | TC005391 | 2.00E−51 |
| 302 | RCC1 domain-containing protein 1 | TC012016 | 3.00E−51 |
| 303 | Equilibrative nucleoside transporter 1 | TC008473 | 3.00E−51 |
| 304 | Anamorsin homolog | TC004939 | 4.00E−51 |
| 305 | Transcription elongation factor B polypeptide 2 | TC004834 | 4.00E−51 |
| 306 | Biogenesis of lysosome-related organelles complex 1 subunit 1 | TC012623 | 4.00E−51 |
| 307 | NADH dehydrogenase (Ubiquinone) 1 beta subcomplex, 7 | TC001945 | 5.00E−51 |
| 308 | Phosphatidylinositol-4,5-bisphosphate 3-kinase catalytic subunit delta isoform | TC011996 | 3.00E−50 |
| 309 | Alpha- and gamma-adaptin-binding protein p34 | TC007613 | 4.00E−50 |
| 310 | Mediator of RNA polymerase II transcription subunit 28 | TC001173 | 5.00E−50 |
| 311 | Novel protein | TC002356 | 6.00E−50 |
| 312 | Ca2+/calmodulin-dependent protein kinase | TC010591 | 8.00E−50 |
| 313 | Mitogen-activated protein kinase kinase 1-interacting protein 1 | TC002357 | 1.00E−49 |
| 314 | Vacuolar protein sorting-associated protein 37B | TC014972 | 1.00E−49 |
| 315 | Tetratricopeptide repeat; Pfam: PF13414 | TC004720 | 4.00E−49 |
| 316 | Putative sodium-coupled neutral amino acid transporter 10 | TC003653 | 4.00E−49 |
| 317 | DDRGK domain-containing protein 1 | TC001171 | 6.00E−49 |
| 318 | Cactin | TC008782 | 1.00E−48 |
| 319 | Novel protein (Zgc:91844) | TC030671 | 2.00E−48 |
| 320 | HIT zinc finger family protein | TC014859 | 2.00E−48 |
| 321 | Mediator of RNA polymerase II transcription subunit 7 | TC007575 | 2.00E−48 |
| 322 | Mitochondrial import inner membrane translocase subunit TIM14 | TC010456 | 2.00E−48 |
| 323 | Transmembrane protein, putative | TC013919 | 5.00E−48 |
| 324 | Mitochondrial ribosomal protein, L46, putative | TC001144 | 1.00E−47 |
| 325 | Prefoldin subunit 1 | TC010530 | 1.00E−47 |
| 326 | F-box only protein, putative | TC003789 | 1.00E−47 |
| 327 | Paraflagellar rod protein | TC010451 | 2.00E−47 |
| 328 | Coiled-coil domain-containing protein 95 | TC009249 | 3.00E−47 |
| 329 | Fez1 | TC004530 | 4.00E−47 |
| 330 | NADH ubiquinone oxidoreductase subunit, putative | TC014412 | 8.00E−47 |
| 331 | Protein C10 | TC005394 | 1.00E−46 |
| 332 | Transmembrane protein 32 | TC014495 | 3.00E−46 |
| 333 | Cell division cycle protein 123 homolog | TC004132 | 8.00E−46 |
| 334 | Novel protein | TC000418 | 2.00E−45 |
| 335 | Coiled-coil domain-containing protein 124 | TC004658 | 2.00E−45 |
| 336 | Ubinuclein | TC008303 | 6.00E−45 |
| 337 | WD40 domain containing protein; Pfam: PF00400 | TC005673 | 7.00E−45 |
| 338 | Tat binding protein 1(TBP-1); Pfam: PF00539 | TC012383 | 9.00E−45 |
| 339 | GPI-anchored wall transfer protein 1 | TC014480 | 2.00E−44 |
| 340 | HCaRG protein; Pfam: PF07258 | TC012212 | 9.00E−44 |
| 341 | Mannose-6-phosphate receptor domain-containing protein | TC005595 | 2.00E−43 |
| 342 | Novel protein | TC012803 | 2.00E−43 |
| 343 | Ribonuclease H2 subunit C | TC002570 | 2.00E−43 |
| 344 | Pre-mRNA splicing factor SF3B 10 kDa subunit, putative | TC016369 | 2.00E−43 |
| 345 | Motile sperm domain-containing protein 1 | TC002877 | 3.00E−43 |
| 346 | UPF0586 protein C1778.07 | TC009347 | 4.00E−43 |
| 347 | Mitochondrial NADH: ubiquinone oxidoreductase B14.7 subunit, putative | TC009025 | 7.00E−43 |
| 348 | Mitochondrial ribosomal protein, L9, putative | TC010194 | 7.00E−43 |
| 349 | MKI67 FHA domain-interacting nucleolar phosphoprotein-like | TC004828 | 8.00E−43 |
| 350 | Mitochondrial ribosomal protein L1 | TC011372 | 1.00E−42 |
| 351 | Putative pterin-4-alpha-carbinol-amine dehydratase | TC010121 | 2.00E−42 |
| 352 | Ecsit | TC015956 | 3.00E−42 |
| 353 | Probable 39S ribosomal protein L49, mitochondrial (fragment) | TC007075 | 8.00E−42 |
| 354 | Brinker | TC000748 | 1.00E−41 |
| 355 | L-aminoadipate-semialdehyde dehydrogenase-phospho-pantetheinyl transferase | TC011251 | 2.00E−41 |
| 356 | Insulin-degrading enzyme | TC001879 | 7.00E−41 |

TABLE 1-continued

| SEQ ID NO. | Annotation | Tribolium Gene Name from OrthoDB database | Blast E-value Tribolium Gene vs Diabrotica Unigene |
|---|---|---|---|
| 357 | Ubiquitin-fold modifier 1 | TC007454 | 8.00E−41 |
| 358 | Autotransporter adhesin, putative | TC006745 | 1.00E−40 |
| 359 | TGF-beta activated kinase 1 | TC005572 | 3.00E−40 |
| 360 | Cyclin-dependent kinase 2-interacting protein | TC009488 | 4.00E−40 |
| 361 | Cytochrome c oxidase assembly protein cox11 | TC003306 | 2.00E−39 |
| 362 | CKLF-like MARVEL transmembrane domain-containing protein 4 | TC014737 | 4.00E−39 |
| 363 | Small androgen receptor-interacting protein | TC012817 | 4.00E−39 |
| 364 | Stathmin | TC013090 | 4.00E−38 |
| 365 | Prolactin regulatory element-binding protein | TC014725 | 6.00E−38 |
| 366 | Serine/threonine-protein phosphatase 4 regulatory subunit 2 | TC008382 | 7.00E−38 |
| 367 | Zgc:152651 protein | TC000873 | 1.00E−37 |
| 368 | Fau | TC015895 | 2.00E−37 |
| 369 | Mitochondrial import inner membrane translocase subunit Tim10, putative | TC003366 | 3.00E−37 |
| 370 | NADH dehydrogenase 1 alpha subcomplex subunit 5 | TC030694 | 3.00E−37 |
| 371 | Mitochondrial ribosomal protein, S18A, putative | TC030560 | 4.00E−37 |
| 372 | Nuclear pore complex protein Nup107 | TC011645 | 5.00E−37 |
| 373 | Protein phosphatase 1 regulatory subunit 14C, putative | TC012424 | 5.00E−37 |
| 374 | FAM98A | TC011549 | 5.00E−37 |
| 375 | RNA-binding protein with serine-rich domain 1 | TC005720 | 8.00E−37 |
| 376 | Coiled-coil domain-containing protein 58 | TC000619 | 8.00E−37 |
| 377 | 28S ribosomal protein S16 | TC009884 | 9.00E−37 |
| 378 | Glyoxylate/hydroxypyruvate reductase A | TC014276 | 3.00E−36 |
| 379 | Transmembrane protein 50A | TC009723 | 3.00E−36 |
| 380 | NADH dehydrogenase [ubiquinone] 1 subunit C2 | TC007636 | 3.00E−36 |
| 381 | Mediator complex | TC012102 | 4.00E−36 |
| 382 | DNL-type zinc finger protein | TC030565 | 4.00E−36 |
| 383 | Ubiquinol-cytochrome c reductase, complex III subunit VII | TC007766 | 5.00E−36 |
| 384 | F13E9.13, mitochondrial | TC004031 | 8.00E−36 |
| 385 | Protein YIPF6 | TC008171 | 2.00E−35 |
| 386 | BAG domain-containing protein Samui | TC006553 | 2.00E−34 |
| 387 | Amsh | TC011383 | 3.00E−34 |
| 388 | Transcription elongation factor 1-like protein | TC030554 | 5.00E−34 |
| 389 | Tumor protein p53-inducible nuclear protein 1 | TC004030 | 6.00E−34 |
| 390 | Novel protein | TC006224 | 7.00E−33 |
| 391 | Guanine nucleotide-releasing factor 2 | TC004461 | 1.00E−32 |
| 392 | Novel protein | TC009815 | 3.00E−32 |
| 393 | Mitochondrial NADH-ubiquinone oxidoreductase 9 kDa subunit-like protein | TC007332 | 5.00E−32 |
| 394 | Sirtuin-5 | TC005187 | 4.00E−31 |
| 395 | TP53RK-binding protein | TC006547 | 2.00E−30 |
| 396 | Transferrin (Fragment) | TC030767 | 5.00E−30 |
| 397 | Novel protein | TC014167 | 1.00E−29 |
| 398 | Regulatory factor X domain-containing protein 2 | TC008959 | 1.00E−29 |
| 399 | Novel protein | TC012215 | 6.00E−29 |
| 400 | Polyadenylate-binding protein-interacting protein, putative | TC004150 | 1.00E−28 |
| 401 | Pallidin | TC008878 | 2.00E−27 |
| 402 | Signal recognition particle 14 kDa protein | TC030566 | 2.00E−27 |
| 403 | Proteasome assembly chaperone 2 | TC002896 | 2.00E−27 |
| 404 | Zinc finger protein 509 | TC030550 | 3.00E−27 |
| 405 | Polyglutamine-binding protein, putative | TC014489 | 2.00E−26 |
| 406 | HCaRG protein; Pfam: PF07258 | TC004291 | 2.00E−26 |
| 407 | Protein lunapark-B | TC009502 | 4.00E−26 |
| 408 | Polyadenylate-binding protein-interacting protein 1 | TC003208 | 5.00E−26 |
| 409 | Peptidase family S49 N-terminal; Pfam: PF08496 | TC002531 | 6.00E−26 |
| 410 | alba-like protein; Pfam: PF01918 | TC006278 | 1.00E−25 |
| 411 | Pre-rRNA-processing protein TSR2; Pfam: PF10273 | TC003011 | 4.00E−25 |
| 412 | Ribosome-associated membrane protein | TC003121 | 7.00E−25 |
| 413 | Novel protein | TC007255 | 3.00E−24 |
| 414 | Intraflagellar transport protein 122-like protein | TC009862 | 4.00E−24 |
| 415 | Chromatin accessibility complex protein 1 | TC005810 | 1.00E−22 |
| 416 | Cag pathogenicity island protein Cag12; Pfam: PF13117 | TC003712 | 4.00E−22 |
| 417 | Novel protein | TC013025 | 1.00E−21 |
| 418 | Mitochondrial NADH: ubiquinone oxidoreductase ESSS subunit, putative | TC030690 | 2.00E−21 |
| 419 | Novel protein | TC002622 | 3.00E−21 |
| 420 | Pogo transposable element with ZNF domain | TC014398 | 4.00E−21 |
| 421 | Exopolysaccharide synthesis, ExoD; Pfam: PF06055 | TC001378 | 7.00E−21 |
| 422 | Transcription elongation factor B polypeptide, putative | TC001477 | 1.00E−20 |
| 423 | Coiled-coil domain-containing protein 137 | TC006678 | 1.00E−20 |
| 424 | Glucocorticoid-induced transcript 1 protein | TC001670 | 2.00E−20 |
| 425 | 24 kDa salivary protein | TC007968 | 5.00E−20 |
| 426 | CD151 antigen, putative | TC008242 | 7.00E−20 |
| 427 | Novel protein | TC001918 | 1.00E−19 |
| 428 | WW domain binding protein 4 | TC011685 | 2.00E−19 |
| 429 | Angiogenic factor with G patch and FHA domains 1 | TC009165 | 2.00E−19 |
| 430 | Novel protein | TC003588 | 3.00E−19 |
| 431 | Chloride ion current inducer protein, putative | TC003587 | 4.00E−19 |
| 432 | Tetratricopeptide repeat protein 7B | TC001250 | 1.00E−18 |
| 433 | Protein HSPC020 homolog | TC004459 | 1.00E−18 |
| 434 | NADH dehydrogenase | TC004001 | 1.00E−18 |
| 435 | Putative mitochondrial precursor protein; Pfam: PF10161 | TC012057 | 6.00E−18 |
| 436 | Protein dispatched | TC010878 | 3.00E−16 |
| 437 | Zinc finger CCHC domain-containing protein 10 | TC010699 | 3.00E−16 |
| 438 | Novel protein | TC013714 | 5.00E−16 |
| 439 | Protein HBXIP-like protein | TC006817 | 8.00E−16 |
| 440 | Novel protein | TC002312 | 8.00E−15 |
| 441 | DSS1/SEM1 family; Pfam: PF05160 | TC003531 | 9.00E−15 |
| 442 | Novel protein | TC003092 | 1.00E−14 |
| 443 | Novel protein | TC010373 | 8.00E−14 |
| 444 | Mitotic phosphoprotein 67 (Fragment) | TC008670 | 8.00E−13 |
| 445 | Novel protein | TC014221 | 2.00E−12 |
| 446 | CDNA sequence | TC030548 | 2.00E−12 |
| 447 | C2H2-type zinc finger; Pfam: PF13912 | TC007119 | 6.00E−12 |
| 448 | Novel protein | TC006599 | 2.00E−09 |
| 449 | Novel protein | TC008147 | 2.00E−08 |
| 450 | 4F5 protein family; Pfam: PF04419 | TC004123 | 4.00E−06 |

This subset of *Diabrotica virgifera virgifera* genes is selected as target genes that are likely to be effective targets for RNAi-mediated silencing methods. These nucleotide sequences (SEQ ID NOs:1-450) are especially useful in designing recombinant polynucleotides for controlling *Diabrotica* species infestations, and in making transgenic plants expressing such recombinant polynucleotides for resistance to *Diabrotica* species infestations.

Example 3

The polynucleotides of this invention are generally designed to modulate expression by inducing regulation or suppression of a *Diabrotica* species target gene and are designed to have a nucleotide sequence essentially identical or essentially complementary to the nucleotide sequence of a *Diabrotica* species target gene (e. g., SEQ ID NOs:1-450) or to the sequence of RNA transcribed from a *Diabrotica* species target gene, which can be coding sequence or non-coding sequence. These effective polynucleotide molecules that modulate expression are referred to herein as a "trigger", or "triggers". This example describes non-limiting techniques useful in the design and selection of polynucleotides as "triggers" to modulate expression of a *Diabrotica* species target gene.

Selection of Polynucleotide Triggers by "Tiling"

Polynucleotides of use in the invention need not be of the full length of a target gene, and in many embodiments are of much shorter length in comparison to the target gene. An example of a technique that is useful for selecting effective triggers is "tiling", or evaluation of polynucleotides corresponding to adjacent or partially overlapping segments of a target gene.

Effective polynucleotide "triggers" can be identified by "tiling" gene targets in selected length fragments, e. g., fragments of 200-300 nucleotides in length, with partially overlapping regions, e. g., of about 25 nucleotides, along the length of the target gene. To suppress a single gene, trigger sequences are designed to correspond to (have a nucleotide identity or complementarity with) regions that are unique to the target gene; the selected region of the target gene can include coding sequence or non-coding sequence (e. g., promoter regions, 3' untranslated regions, introns and the like) or a combination of both.

Where it is of interest to design a target effective in suppressing multiple target genes, the multiple target gene sequences are aligned and polynucleotide triggers designed to correspond to regions with high sequence homology in common among the multiple targets. Conversely, where it is of interest to design a target effective in selectively suppressing one among multiple target sequences, the multiple target gene sequences are aligned and polynucleotide triggers designed to correspond to regions with no or low sequence homology in common among the multiple targets.

In a non-limiting example, anti-sense single-stranded RNA triggers are designed for each of the target genes listed in Table 1 as follows. Multiple anti-sense single-stranded RNA triggers, each of 200-300 nucleotides in length and with a sequence corresponding to (i. e., for anti-sense triggers, complementary to) a fragment of a target gene having a sequence selected from SEQ ID NOs:1-450 are designed so that each trigger's sequence overlaps about 25 nucleotides of the next adjacent trigger's sequence, in such a way that the multiple triggers in combination cover the full length of the target gene. (Sense triggers are designed in an analogous fashion, where the trigger sequence is identical to a fragment of the target gene. Similarly, double-stranded triggers can be designed by providing pairs of sense and anti-sense triggers, each pair of triggers overlapping the next adjacent pair of triggers.)

The polynucleotide triggers are tested by any convenient means for efficacy in silencing the *Diabrotica* species target gene. An example of a suitable test is a diet bioassay such as the Western corn rootworm (*Diabrotica virgifera virgifera* LeConte) larval bioassay described in International Patent Application Publication WO2005/110068 A2 and U.S. Patent Application Publication US 2006/0021087 A1, specifically incorporated by reference. Another test involves the topical application of the polynucleotide triggers either directly to *Diabrotica* individuals or to the surface of a plant to be protected from a *Diabrotica* species infestation. One desired result of treatment with a polynucleotide of this invention is prevention or control of a *Diabrotica* species infestation, e. g., by inducing in a *Diabrotica* insect a physiological or behavioural change such as, but not limited to, growth stunting, increased mortality, decrease in reproductive capacity, decrease in or cessation of feeding behavior or movement, or decrease in or cessation of metamorphosis stage development. Another desired result of treatment with a polynucleotide of this invention is provision of a plant that exhibits improved resistance to a *Diabrotica* species infestation, such as a maize (*Zea mays*) plant that exhibits improved resistance to an infestation by *Diabrotica virgifera virgifera* (Western Corn Rootworm, WCR), *Diabrotica undecimpunctata howardii* (Southern Corn Rootworm, SCR), *Diabrotica barberi* (Northern Corn Rootworm, NCR), *Diabrotica virgifera zeae* (Mexican Corn Rootworm, MCR), *Diabrotica balteata* (Brazilian Corn Rootworm, BZR), or Brazilian Corn Rootworm complex (BCR) consisting of *Diabrotica viridula* and *Diabrotica speciosa*.

The tiling procedure can be repeated, if desired. A polynucleotide trigger found to provide desired activity can itself be subjected to a tiling procedure. For example, multiple overlapping anti-sense single-stranded RNA triggers are designed, each of 50-60 nucleotides in length and with a sequence corresponding to (i. e., for anti-sense triggers, complementary to) the fragment of a target gene having a sequence selected from SEQ ID NOs:1-450 for which a single polynucleotide trigger of 300 nucleotides was found to be effective. Additional rounds of tiling analysis can be carried out, where triggers as short as 18 or 19 nucleotides are tested.

Effective polynucleotide triggers of any size can be used, alone or in combination, in the various methods of this invention. In some embodiments, a single polynucleotide trigger is used to make a composition of this invention (e. g., a composition for topical application, or a recombinant DNA construct useful for making a transgenic plant). In other embodiments, a mixture or pool of different polynucleotide triggers is used; in such cases the polynucleotide triggers can be for a single target gene or for multiple target genes.

Thermodynamic Considerations in Selecting Polynucleotide Triggers

Polynucleotide triggers can be designed or their sequence optimised using thermodynamic considerations. For example, polynucleotide triggers can be selected based on the thermodynamics controlling hybridization between one nucleic acid strand (e. g., a polynucleotide trigger or an individual siRNA) and another (e. g., a target gene transcript)

Methods and algorithms to predict nucleotide sequences that are likely to be effective at RNAi-mediated silencing of a target gene are known in the art. Non-limiting examples of such methods and algorithms include "i-score", described by Ichihara et al. (2007) *Nucleic Acids Res.*, 35(18): 123e; "Oligowalk", publicly available at ma.urmc.rochester.edu/servers/oligowalk and described by Lu et al. (2008) *Nucleic Acids Res.*, 36:W104-108; and "Reynolds score", described by Khovorova et al. (2004) *Nature Biotechnol.*, 22:326-330.

Permitted Mismatches

By "essentially identical" or "essentially complementary" is meant that the trigger polynucleotide (or at least one strand of a double-stranded polynucleotide) has sufficient identity or complementarity to the target gene or to the RNA transcribed from a target gene (e. g., the transcript) to suppress expression of a target gene (e. g., to effect a reduction in levels or activity of the target gene transcript and/or encoded protein). Polynucleotides of this invention need not have 100 percent identity or complementarity to a target gene or to the RNA transcribed from a target gene to suppress expression of the target gene (e. g., to effect a reduction in levels or activity of the target gene transcript or encoded protein, or to provide control of a *Diabrotica* species). In some embodiments, the polynucleotide or a portion thereof is designed to be essentially identical to, or essentially complementary to, a sequence of at least 18 or 19 contiguous nucleotides in either the target gene or the RNA transcribed from the target gene. In certain embodiments, an "essentially identical" polynucleotide has 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the endogenous target gene or to an RNA transcribed from the target gene. In certain embodiments, an "essentially complementary" polynucleotide has 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene.

Polynucleotides containing mismatches to the target gene or transcript can be used in certain embodiments of the compositions and methods of this invention. In some embodiments, the polynucleotide includes at least 18 or at least 19 contiguous nucleotides that are essentially identical or essentially complementary to a segment of equivalent length in the target gene or target gene's transcript. In certain embodiments, a polynucleotide of 19 contiguous nucleotides that is essentially identical or essentially complementary to a segment of equivalent length in the target gene or target gene's transcript can have 1 or 2 mismatches to the target gene or transcript (i. e., 1 or 2 mismatches between the polynucleotide's 19 contiguous nucleotides and the segment of equivalent length in the target gene or target gene's transcript). In certain embodiments, a polynucleotide of 20 or more nucleotides that contains a contiguous 19 nucleotide span of identity or complementarity to a segment of equivalent length in the target gene or target gene's transcript can have 1 or 2 mismatches to the target gene or transcript. In certain embodiments, a polynucleotide of 21 continuous nucleotides that is essentially identical or essentially complementary to a segment of equivalent length in the target gene or target gene's transcript can have 1, 2, or 3 mismatches to the target gene or transcript. In certain embodiments, a polynucleotide of 22 or more nucleotides that contains a contiguous 21 nucleotide span of identity or complementarity to a segment of equivalent length in the target gene or target gene's transcript can have 1, 2, or 3 mismatches to the target gene or transcript.

In designing polynucleotides with mismatches to an endogenous target gene or to an RNA transcribed from the target gene, mismatches of certain types and at certain positions that are more likely to be tolerated can be used. In certain exemplary embodiments, mismatches formed between adenine and cytosine or guanosine and uracil residues are used as described by Du et al. (2005) *Nucleic Acids Res.*, 33:1671-1677. In some embodiments, mismatches in 19 base-pair overlap regions are located at the low tolerance positions 5, 7, 8 or 11 (from the 5' end of a 19-nucleotide target), at medium tolerance positions 3, 4, and 12-17 (from the 5' end of a 19-nucleotide target), and/or at the high tolerance positions at either end of the region of complementarity, i. e., positions 1, 2, 18, and 19 (from the 5' end of a 19-nucleotide target) as described by Du et al. (2005) *Nucleic Acids Res.*, 33:1671-1677. Tolerated mismatches can be empirically determined in routine assays, e. g., in in vitro dietary assays on *Diabrotica* species larvae.

Embedding Active Triggers in Neutral Sequence

In an embodiment, a bioactive trigger (i. e., a polynucleotide with a sequence corresponding to the target gene and which is responsible for an observed suppression of the target gene) is embedded in "neutral" sequence, i. e., inserted into additional nucleotides that have no sequence identity or complementarity to the target gene. Neutral sequence can be desirable, e. g., to increase the overall length of a polynucleotide. For example, it can be desirable for a polynucleotide to be of a particular size for reasons of stability, cost-effectiveness in manufacturing, or biological activity.

It has been reported that for *Diabrotica virgifera virgifera* dsRNAs greater than or equal to approximately 60 base-pairs (bp) are required for biological activity in artificial diet bioassays; see Bolognesi et al. (2012) *PLoS ONE* 7(10): e47534. Thus, in one embodiment, a 21-base-pair dsRNA trigger corresponding to a target gene in Table 1 and found to provide control of a *Diabrotica* infestation is embedded in neutral sequence of an additional 39 base pairs, thus forming a polynucleotide of about 60 base pairs. In another embodiment, a single 21-base-pair trigger is found to be efficacious when embedded in larger sections of neutral sequence, e. g., where the total polynucleotide length is from about 60 to about 300 base pairs.

Example 4

This example illustrates a non-limiting assay useful for evaluating the *Diabrotica*-controlling efficacy of a polynucleotide of this invention including at least 18 contiguous nucleotides that are essentially identical or complementary to a segment of equivalent length of a DNA having a sequence selected from the group consisting of SEQ ID NOs:1-450, or including at least 18 contiguous nucleotides that are essentially identical or complementary to a segment of equivalent length of a DNA of a target gene selected from the group consisting of the genes identified in Table 1, or compositions including such polynucleotides.

Double-stranded RNA (dsRNA) triggers for each of the target genes with a sequence selected from SEQ ID NOs: 1-450 (i. e., the 450 target genes identified in Table 1) are designed and selected as described in Examples 2 and 3 and are tested in a bioassay. Each trigger is about 500 base pairs in length with a sequence of contiguous nucleotides corresponding to an open reading frame of a target gene with a sequence selected from SEQ ID NOs:1-450 (i. e., a target gene selected from the 450 target genes identified in Table 1); where the open reading frame is shorter than 500 nucleotides, a shorter trigger is used. At least one trigger for each of the 450 target genes is tested; for selected target genes multiple triggers are tested. The triggers are chemically synthesized by in vitro transcription using a T7 RNA polymerase, using standard methodology. The RNA transcription products are purified from the T7 reaction mixture and are used either directly in the bioassay or are modified prior to the bioassay by digestion with RNAse III (Ambion Corporation, Austin, Tex.) or DICER (Stratagene, La Jolla, Calif.) to produce twenty-one and twenty-two nucleotide duplexes containing 5' phosphorylated ends and 3' hydroxyl ends with 2-3 base overhangs. The dsRNA triggers for suppressing each of the 450 target genes are tested in a diet bioassay using *Diabrotica virgifera virgifera* larvae, wherein mortality or stunting of the larvae due to contact with or ingestion of the polynucleotide triggers is assayed, is carried out as follows.

*Diabrotica virgifera virgifera* (WCR) eggs are obtained from Crop Characteristics, Inc., Farmington, Minn. The non-diapausing WCR eggs are incubated in soil for about 13 days at 24 degrees Celsius, 60% relative humidity, in complete darkness. On day 13 the soil containing WCR eggs is placed between #30- and #60-mesh sieves and the eggs are washed out of the soil with water from a hose. The eggs are surface-disinfected by soaking in a LYSOL® (Reckitt Benckiser LLC, Parsippany, N.J.) solution for three minutes, rinsed three times with sterile water, washed one time with a 10% formalin solution and then rinsed three additional times in sterile water. The eggs are then dispensed onto sterile coffee filters and hatched overnight at 27 degrees Celsius, 60% relative humidity, in complete darkness.

Insect diet is prepared essentially according to Pleau et al. (2002) *Entomologia Experimentalis et Applicata*, 105:1-11, with some modifications. 9.4 grams of Serva agar is dispensed into 540 milliliters of purified water and agitated until the agar is thoroughly distributed. The water/agar mixture is heated to boiling to completely dissolve the agar, and poured into a Waring blender. The blender is maintained at low speed while 62.7 grams of Bio-Serv mix (F9757), 3.75 grams lyophilized maize root, 1.25 milliliters of green food coloring, and 0.6 milliliters of formalin are added to the hot agar mixture. The mixture is then adjusted to pH 9.0 with the addition of a 10% potassium hydroxide solution. The approximately 600 milliliter volume of liquid diet is continually mixed at high speed and maintained at from about 48 to about 60 degrees Celsius using a sterilized Nalgene-coated magnetic stir bar on a magnetic stirring hot plate while being dispensed in aliquots of 200 microliters into each well of FALCON 96-well round bottom microtiter plates. The diet in the plates is allowed to solidify and air dry in a sterile biohood for about ten minutes.

Thirty (30) microliter volumes of test samples, containing either control reagents or the polynucleotide (dsRNA triggers) to be tested in varying quantities, are overlayed onto the surface of the solidified insect diet in each well. The plates are allowed to stand in a sterile biohood for up to one half hour after application of test samples to allow the reagents to diffuse into the diet and to allow the surface of the diet to dry. One WCR neonate larva is deposited in each well with a fine paintbrush. Plates are then sealed with Mylar and ventilated using an insect pin. From 12 to 72 larvae are tested per dose, depending on the design of the assay. The bioassay plates are incubated at 27 degrees Celsius, 60% relative humidity, in complete darkness for 12-14 days. Mortality or stunting of the larvae is observed at the last (12-14) day time point: the number of surviving larvae per dose is recorded and larval mass is determined by weighing each surviving larva with an analytical balance. Data are analyzed using JMP©4 statistical software (SAS Institute, 1995) and a full factorial ANOVA is conducted with a Dunnett's test to look for treatment effects compared to the untreated control ($P<0.05$). A Tukey-Kramer post hoc test is performed to compare all pairs of the treatments ($P<0.05$).

It is anticipated that the combination of certain recombinant RNAs of this invention (e. g., the dsRNA triggers described herein) with one or more non-polynucleotide pesticidal agents will result in a synergetic improvement in prevention or control of *Diabrotica* species infestations, when compared to the effect obtained with the recombinant RNA alone or the non-polynucleotide pesticidal agent alone. Routine insect bioassays such as the bioassay employing an artificial diet described here are useful for defining dose-responses for larval mortality or growth inhibition using combinations of the polynucleotides of this invention and one or more non-polynucleotide pesticidal agents (e. g., a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein). One of skill in the art can test combinations of polynucleotides and non-polynucleotide pesticidal agents in routine bioassays to identify combinations of bioactives that are synergistic and desirable for use in protecting plants from *Diabrotica* species infestations.

Example 5

This example illustrates non-limiting embodiments of the use of polynucleotides of this invention in topically applied compositions for preventing or controlling *Diabrotica* species infestations.

Compositions containing one or more polynucleotides of this invention are useful as topical treatments of plants, animals, or environments wherein prevention or control of a *Diabrotica* species infestation is desired. In embodiments, a polynucleotide of this invention (e. g., a dsRNA trigger for each of the target genes with a sequence selected from SEQ ID NOs:1-450, i. e., the 450 target genes identified in Table 1, as described in Examples 3 and 4 above) is included in an effective amount in a composition designed to be provided directly (e. g., by contact or ingestion) to a *Diabrotica* species, or a plant or environment wherein prevention or control of infestation by that *Diabrotica* species is desired. Such compositions are formulated and manufactured according to the art and can be in any convenient form, e. g., a solution or mixture of solutions, an emulsion, a suspension, a dispersible powder, a solid or liquid bait, a seed coating, or a soil drench. Embodiments of such compositions include those where the polynucleotide of this invention is provided in a living or dead microorganism such as a bacterium or fungal or yeast cell, or provided as a microbial fermentation product, or provided in a living or dead plant cell, or provided as a synthetic recombinant polynucleotide. In an embodiment the composition includes a non-pathogenic strain of a microorganism that contains a polynucleotide of this invention; ingestion or intake of the microorganism results in stunting or mortality of the *Diabrotica* species; non-limiting examples of suitable microorganisms include *E. coli*, *B. thuringiensis*, *Pseudomonas* sp., *Photorhabdus* sp., *Xenorhabdus* sp., *Serratia entomophila* and related *Serratia* sp., *B. sphaericus*, *B. cereus*, *B. laterosporus*, *B. popilliae*, *Clostridium bifermentans* and other *Clostridium* species, or other spore-forming gram-positive bacteria. In an embodiment, the composition includes a plant virus vector including a polynucleotide of this invention; feeding by a *Diabrotica* species on a plant treated with the plant virus vector results in stunting or mortality of the *Diabrotica* species. In an embodiment, the composition includes a baculovirus vector including a polynucleotide of this invention; ingestion or intake of the vector results in stunting or mortality of the *Diabrotica* species. In an embodiment, a polynucleotide of this invention is encapsulated in a synthetic matrix such as a polymer or attached to particulates and topically applied to the surface of a plant; feeding by a *Diabrotica* species on the topically treated plant results in stunting or mortality of the *Diabrotica* species. In an embodiment, a polynucleotide of this invention is provided in the form of a plant cell (e. g., a transgenic maize plant cell of this invention) expressing the polynucleotide; ingestion of the plant cell or contents of the plant cell by a *Diabrotica* species results in stunting or mortality of the *Diabrotica* species.

Such compositions can include the appropriate stickers and wetters required for efficient foliar coverage as well as UV protectants to protect polynucleotides such as dsRNAs from UV damage. Such additives are commonly used in the bioinsecticide industry and are known to those skilled in the art. Compositions for soil application can include granular formulations that serve as bait for *Diabrotica* species larvae. Such compositions can include a carrier agent, a surfactant, an organosilicone, a polynucleotide herbicidal molecule, a non-polynucleotide herbicidal molecule, a non-polynucleotide pesticide, a safener, and an insect growth regulator. In embodiments, the composition further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

Such compositions are applied in any convenient manner, e. g., by spraying or dusting the *Diabrotica* species directly, or spraying or dusting a plant or environment wherein prevention or control of infestation by that *Diabrotica* species is desired, or by applying a coating to a surface of a plant, or by applying a coating to a seed in preparation for the seed's planting, or by applying a soil drench around roots of a plant for which prevention or control of infestation by that *Diabrotica* species is desired.

An effective amount of a polynucleotide of this invention is an amount sufficient to provide control of the *Diabrotica* species, or to prevent infestation by the *Diabrotica* species; determination of effective amounts of a polynucleotide of this invention are made using routine assays such as those described in Example 4 above. While there is no upper limit on the concentrations and dosages of a polynucleotide of this invention that can be useful in the methods and compositions provided herein, lower effective concentrations and dosages will generally be sought for efficiency. The concentrations can be adjusted in consideration of the volume of spray or treatment applied to plant leaves or other plant part surfaces, such as flower petals, stems, tubers, fruit, anthers, pollen, leaves, roots, or seeds. In one embodiment, a useful treatment for herbaceous plants using 25-mer polynucleotides of this invention is about 1 nanomole (nmol) of polynucleotides per plant, for example, from about 0.05 to 1 nmol polynucleotides per plant. Other embodiments for herbaceous plants include useful ranges of about 0.05 to about 100 nmol, or about 0.1 to about 20 nmol, or about 1 nmol to about 10 nmol of polynucleotides per plant. In certain embodiments, about 40 to about 50 nmol of a ssDNA polynucleotide of this invention is applied. In certain embodiments, about 0.5 nmol to about 2 nmol of a dsRNA of this invention is applied. In certain embodiments, a composition containing about 0.5 to about 2.0 mg/mL, or about 0.14 mg/mL of a dsRNA or an ssDNA (21-mer) of this invention is applied. In certain embodiments, a composition of about 0.5 to about 1.5 mg/mL of a dsRNA polynucleotide of this invention of about 50 to about 200 or more nucleotides is applied. In certain embodiments, about 1 nmol to about 5 nmol of a dsRNA of this invention is applied to a plant. In certain embodiments, the polynucleotide composition as topically applied to the plant contains at least one polynucleotide of this invention at a concentration of about 0.01 to about 10 milligrams per milliliter, or about 0.05 to about 2 milligrams per milliliter, or about 0.1 to about 2 milligrams per milliliter Very large plants, trees, or vines can require correspondingly larger amounts of polynucleotides. When using long dsRNA molecules of this invention that can be processed into multiple oligonucleotides (e. g., multiple triggers encoded by a single recombinant DNA molecule of this invention), lower concentrations can be used. Non-limiting examples of effective polynucleotide treatment regimes include a treatment of between about 0.1 to about 1 nmol of polynucleotide molecule per plant, or between about 1 nmol to about 10 nmol of polynucleotide molecule per plant, or between about 10 nmol to about 100 nmol of polynucleotide molecule per plant.

Embodiments of compositions of this invention include a "transfer agent", i. e., an agent that, when combined with a composition including a polynucleotide of this invention that is topically applied to the surface of an organism, enables the polynucleotide to enter the cells of that organism. Such transfer agents can be incorporated as part of the composition including a polynucleotide of this invention, or can be applied prior to, contemporaneously with, or following application of the composition including a polynucleotide of this invention. In embodiments, a transfer agent is an agent that improves the uptake of a polynucleotide of this invention by a *Diabrotica* species. In embodiments, a transfer agent is an agent that conditions the surface of plant tissue, e. g., seeds, leaves, stems, roots, flowers, or fruits, to permeation by a polynucleotide of this invention into plant cells. In embodiments, the transfer agent enables a pathway for a polynucleotide of this invention through cuticle wax barriers, stomata, and/or cell wall or membrane barriers into plant cells.

Suitable transfer agents include agents that increase permeability of the exterior of the organism or that increase permeability of cells of the organism to polynucleotides of this invention. Suitable transfer agents include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or combinations thereof. In embodiments, application of a composition of this invention and a transfer agent optionally includes an incubation step, a neutralization step (e. g., to neutralize an acid, base, or oxidizing agent, or to inactivate an enzyme), a rinsing step, or combinations thereof. Suitable transfer agents can be in the form of an emulsion, a reverse emulsion, a liposome, or other micellar-like composition, or can cause the polynucleotide composition to take the form of an emulsion, a reverse emulsion, a liposome, or other micellar-like composition. Embodiments of transfer agents include counter-ions or other molecules that are known to associate with nucleic acid molecules, e. g., inorganic ammonium ions, alkyl ammonium ions, lithium ions, polyamines such as spermine, spermidine, or putrescine, and other cations. Embodiments of transfer agents include organic solvents such as DMSO, DMF, pyridine, N-pyrrolidine, hexamethylphosphoramide, acetonitrile, dioxane, polypropylene glycol, or other solvents miscible with water or that dissolve phosphonucleotides in non-aqueous systems (such as is used in synthetic reactions). Embodiments of transfer agents include naturally derived or synthetic oils with or without surfactants or emulsifiers, e. g., plant-sourced oils, crop oils (such as those listed in the 9th Compendium of Herbicide Adjuvants, publicly available on-line at herbicide.adjuvants.com), paraffinic oils, polyol fatty acid esters, or oils with short-chain molecules modified with amides or polyamines such as polyethyleneimine or N-pyrrolidine.

Embodiments of transfer agents include organosilicone preparations. For example, a suitable transfer agent is an organosilicone preparation that is commercially available as Silwet® L-77 surfactant having CAS Number 27306-78-1 and EPA Number: CAL.REG.NO. 5905-50073-AA, and currently available from Momentive Performance Materials, Albany, N.Y. In embodiments where a Silwet L-77 organosilicone preparation is used as transfer agent in the form of a spray treatment (applied prior to, contemporaneously with, or following application of the composition including a polynucleotide of this invention) of plant leaves or other plant surfaces, freshly made concentrations in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of a polynucleotide of this invention into plant cells from a topical application on the surface. One embodiment includes a composition that comprises a polynucleotide of this invention and a transfer agent including an organosilicone preparation such as Silwet L-77 in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent). One embodiment includes a composition that comprises a polynucleotide of this invention and a transfer agent including Silwet L-77 in the range of about 0.3 to about 1 percent by weight (wt percent) or about 0.5 to about 1% by weight (wt percent).

Organosilicone compounds useful as transfer agents for use in this invention include, but are not limited to, compounds that include: (a) a trisiloxane head group that is covalently linked to, (b) an alkyl linker including, but not limited to, an n-propyl linker, that is covalently linked to, (c) a polyglycol chain, that is covalently linked to, (d) a terminal group. Trisiloxane head groups of such organosilicone compounds include, but are not limited to, heptamethyltrisiloxane. Alkyl linkers can include, but are not limited to, an n-propyl linker. Polyglycol chains include, but are not limited to, polyethylene glycol or polypropylene glycol. Polyglycol chains can comprise a mixture that provides an average chain length "n" of about "7.5". In certain embodiments, the average chain length "n" can vary from about 5 to about 14. Terminal groups can include, but are not limited to, alkyl groups such as a methyl group. Organosilicone compounds useful as transfer agents for use in this invention include, but are not limited to, trisiloxane ethoxylate surfactants or polyalkylene oxide modified heptamethyl trisiloxane. An example of a transfer agent for use in this invention is Compound I:

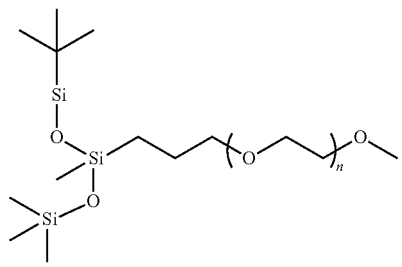

(Compound I: Polyalkyleneoxide Heptamethyltrisiloxane, Average n=7.5).

Organosilicone compounds useful as transfer agents for use in this invention are used, e. g., as freshly made concentrations in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent).

Embodiments of transfer agents include one or more salts such as ammonium chloride, tetrabutylphosphonium bromide, and ammonium sulfate, provided in or used with a composition including a polynucleotide of this invention. In embodiments, ammonium chloride, tetrabutylphosphonium bromide, and/or ammonium sulfate are used at a concentration of about 0.5% to about 5% (w/v), or about 1% to about 3% (w/v), or about 2% (w/v). In certain embodiments, the composition including a polynucleotide of this invention includes an ammonium salt at a concentration greater or equal to 300 millimolar. In certain embodiments, the composition including a polynucleotide of this invention includes an organosilicone transfer agent in a concentration of about 0.015 to about 2 percent by weight (wt percent) as well as ammonium sulfate at concentrations from about 80 to about 1200 mM or about 150 mM to about 600 mM.

Embodiments of transfer agents include a phosphate salt. Phosphate salts useful in a composition including a polynucleotide of this invention include, but are not limited to, calcium, magnesium, potassium, or sodium phosphate salts. In certain embodiments, the composition including a polynucleotide of this invention includes a phosphate salt at a concentration of at least about 5 millimolar, at least about 10 millimolar, or at least about 20 millimolar. In certain embodiments, the composition including a polynucleotide of this invention includes a phosphate salt in a range of about 1 mM to about 25 mM or in a range of about 5 mM to about 25 mM. In certain embodiments, the composition including a polynucleotide of this invention includes sodium phosphate at a concentration of at least about 5 millimolar, at least about 10 millimolar, or at least about 20 millimolar. In certain embodiments, the composition including a polynucleotide of this invention includes sodium phosphate at a concentration of about 5 millimolar, about 10 millimolar, or about 20 millimolar. In certain embodiments, the composition including a polynucleotide of this invention includes a sodium phosphate salt in a range of about 1 mM to about 25 mM or in a range of about 5 mM to about 25 mM. In certain embodiments, the composition including a polynucleotide of this invention includes a sodium phosphate salt in a range of about 10 mM to about 160 mM or in a range of about 20 mM to about 40 mM. In certain embodiments, the composition including a polynucleotide of this invention includes a sodium phosphate buffer at a pH of about 6.8.

Embodiments of transfer agents include surfactants and/or effective molecules contained therein. Surfactants and/or effective molecules contained therein include, but are not limited to, sodium or lithium salts of fatty acids (such as tallow or tallowamines or phospholipids) and organosilicone surfactants. In certain embodiments, the composition including a polynucleotide of this invention is formulated with counter-ions or other molecules that are known to associate with nucleic acid molecules. Non-limiting examples include, tetraalkyl ammonium ions, trialkyl ammonium ions, sulfonium ions, lithium ions, and polyamines such as spermine, spermidine, or putrescine. In certain embodiments, the composition including a polynucleotide of this invention is formulated with a non-polynucleotide herbicide e. g., glyphosate, auxin-like benzoic acid herbicides including dicamba, chloramben, and TBA, glufosinate, auxin-like herbicides including phenoxy carboxylic acid herbicide, pyridine carboxylic acid herbicide, quinoline carboxylic acid herbicide, pyrimidine carboxylic acid herbicide, and benazolin-ethyl herbicide, sulfonylureas, imidazolinones, bromoxynil, delapon, cyclohezanedione, protoporphyrinogen oxidase inhibitors, and 4-hydroxyphenyl-pyruvate-dioxygenase inhibiting herbicides. In certain embodiments, the composition including a polynucleotide of this invention is formulated with a non-polynucleotide pesticide, e. g., a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

All of the materials and methods disclosed and claimed herein can be made and used without undue experimentation as instructed by the above disclosure. Although the materials and methods of this invention have been described in terms of preferred embodiments and illustrative examples, it will be apparent to those of skill in the art that variations can be applied to the materials and methods described herein without departing from the concept, spirit and scope of this invention. All such similar substitutes and modifications apparent to those skilled in the art are deemed to be within the spirit, scope and concept of this invention as defined by the appended claims.

SEQUENCE LISTING (450 sequences)

SEQ ID NO: 1 - DNA, 1620 bp, Diabrotica virgifera
  Annotation=Sorting nexin-6
  SmartBlast Evalue=1E-141; Info=Sorting nexin-6 n=2 Tax= Formicidae RepID=E2AKQ5_9HYME
tggtgttcttgtggaatgactggctttaataaataaaatattaatcgcatctcacaattttaataaaacagaatcatgtcagatagatctccagatgaaggtaataatgtgcctctcacagacagttcccttattgtggatatttctgatgcgctcagcgaaaaagataaagttaagttcactgtccacactcgcacttcaatgaagaatttccagaaacaagagtttttagttgtcagacagcatgaagagttcatatggcttcatgatcgttatgaagaagagcctaaatatgcgggatatattatcccaccaccaccaccccgtccaaatttcgatgcttctcgtgaaaagttacaacgcttaggtgaaggggaaggcaccatgaccaaagaggaatttacgaaaatgaaacaggaattagaggcagaatatctcgccaccttcaaaaaaacggttgcgatgcacgaagtattcctcactcgattagctagtcattccatatttagagaagaccaacaccttcacgtttttctcgaatatgatcaagatttgtgtgcccgtcctaaagggaagctccagcagttgggaggtctcataaagtcagtaggaaccactactgaccagtattacctaaacgccacagttagagatgtgaacgatttctttgaacagcagatgaactcgttaacggagtaccacaatcagttaaaggatgcaacttatcggactgataagatgactgaaaagcacaaagaactagccgatagctatattaaaatatccgggggattaattcaactagcgaacagtgataacggaagactagataaatatttgtcgagggtatctgatacattcgaaaaggttaggaaattagaaagtcgagtggctagcgatcaggatctaaagttggccgatacacttcgatactatatgagggacagccaagctgctcgagctcttctggtgcgccgacttaggtgtttagcaaattacgaaaatgccaacaaaactctcgaaaaagctcgtcataaaaataaggaaattcacgcggcggagaaagctcaatctgttgcatgtgaacaattcgaatcgatatctgcccaagccaaggaagaattactcgattttaaaactaggaggctacacgcatttagaaaaagtttgatagaattggccgaattagaaattaagcatgctcgtagtcaacatgatctactgaaaaaatctatagctaatctcaatgagttactctgagccgttttactgctctcatttttttatattacacgttcatatcaagatattgaaaacattgtttacgggaatggtgtatttaattttatatttgtctttcgtttttaggcaatgagatctcatttatatgcttattagtttaaacgcttattagttgttccattatatctttgcacaaacgtcatgattactgtcaatgtattaataattaggaaatggctattatccgtcgacgtattgtataaagttacattgtaaatttatatttaactattttataatatatttaacacagtataactttataaataacccaatttaagttataaattccaataaacataacaaataagcgttaat

SEQ ID NO: 2 - DNA, 7731 bp, Diabrotica virgifera
  Annotation=Alpha spectrin
  SmartBlast Evalue=0; Info=Alpha spectrin n=2 Tax=Tribolium castaneum RepID=D6W8J4_TRICA
gttgattaccaaggaggtgccattttgtggctccagaaaattttttagtaaagaccagtgaagtgaagttactgtggacattattcttgataaaaaaaacgttttatgacctcttcaaattaacgactacgattgagaaccatccacacacatagcgacccgaataccacccaaacatggatcaaatcccccctccaaaggaggttaagatcctcgaaaccgccgaggatatccaggaacgtcgtcaggaagtcttatcccgctacgacaacttcaaagccgacgctagagctaagagggagaagttagaagattccagaaggttccaatacttcaagagagacgccgatgaattggaatcatggattttggagaaactacaggcagctagtgacgaaagttacaaagatcctaccaatttgcaagctaagattcagaaacatcaagcctttgaagctgaagtcgctgctcatagcaatgctatcgtcgttttagacaatactggtagagagatgatcaatcagaaccattatgagagcgaaactatcagaagacgtttggaggaacttcatagactttgggaacaacttctttccaaactggccgaaaaaggcaccaaacttcaacaagctctagttctcgtccagtttattcgtcattgcgacgaagtcatgttctggattaacgaaaaaagcgcttttctttccgccgaagagtttggccatgacttagaacacgtagaagtcttgcagcgcaaattcgacgaattccaaaaagacatggcttcccaagaataccgagttacagaagtcaacgaactggctgataaattgctacatgacggacacccagagagagaccaaatcatcacaagaaaagaagaattaaataacgcttggcaacgccttaagcaaatgacattgatgcgtcaagacaaactctatggcgctcatgaaatccagcgctacaacagggatgccgacgaaactgttgcatggatcgccgaaaaggatgttgtgctatcttcagatgattacggtagagatttggcaagtgtgcaagctttgcaacgtaagcacgaaggcgttgaaagagatttggcagctttggaagataaagtatctaccttgggtaaagaagcagatagactgggagctatccacgatgaccatggcgatgtaattcaatctaagaggtcagaaattcaagattattggcacagtttgactgctaaagccaaggaaagacgtgaaaagttggaagaatcatacgcccttcaccgcttcctagccgatttcagagacttggtccactggatcaatgacatgaaagccatcatttccgcagacgaactggcgaaagatgttgctggagctgaagccttgttagaaagacatcaagaacacagaggcgaaattgacgctagagaagacagctttaaatccaccaccgaagctgggcaagctctcttggacaaaggacattatgccagtgacgaagtcaaagaaaaactgtctatgttggaatctgacaagagatctttgatttcgctttgggatgaaagacgcattttgtatgagcagtgtatggatttgcaagtcttctacagagacacagaacaggctgacacctggatggcgaaacaagaagcgtttttagccaacgaagaccttggcgattctttggactctgttgaagctcttatcaagaaacacgaagatttcgaaaagtctttggcagcacaagaagagaagattaaagccttagatgaatttgctaccaagttgatagatggcgaacattatgcggctgatgatgtagctcaaagacgagctatgcttttggaacgccgcaaggctctcaaagaaaaatctagtattcgcagagaaacgctggaggacgcttacaaactacaacagtttgaaagagattgtgacgaaaccaaagggtggattaacgaaaaacttaaattcgcaaccgacgagagttatttggaccctactaatttgggaggcaaagtacagaaacatcaaaatttcgaacaagaactcaatgccaacaaatcaagaatggaagatattacatcaactgggcaagaactcatcgaggctgaccattatgctgcacctcgtattcaatcaagaatggaagagatcgtgaacctttgggagactttggttcaatcaacagataaaaagaattcaaagcttcaagaagccagtcaacagcagcaattcaacagaaccatcgaagatatcgagttgtggctatctgagattgaaggtcagcttatgtcagaagattatggcaaagatctgacgtctgtgcaaaatttacagaagaaacacggtttgttggagggagatgtcgcatcacatcaagatagaatcgaaagtatcacttctgctgctaaccagtttgtagaaagaggacactttgatgctgacaacatcgctcacaaacagaaggttctgaccgatagatatgcagctcttcaaacaccgatggcagttagaaagcaaaggttgttggattcacatcaagttcaacagttgtttagagacattgaggatgaagaagcttggattagagaaaaggaacccgttgctgcaagcacaaatagaggtcgcgatttgattggagtacaaaacttgatcaaaaaacaccaggcagtattggccgaaattaacaaccacgaaggtcgtataagtgctgtcattgacgctggtaagcagatgatggaagatgaacactttgctagtgacgaaatcagaaatagagtaaatgctcttaatgatcattgggactctcttaaggaaaagtcaacccaacgcaaacaagaccttgaagattcccttcaagcccaccaatattacgccgatgctaacgaggctgaatcttggatgagagaaaaggagccgattgtcagtaacactgattacggaaaggacgaagattcttccgaagctcttttgaagaaacatgaggctttgatgagcgatttggctgcttttggaaacacaatcgatggcttaaaagaacaggctcgtagctgcaggcaacaagagccaccagtagttgatgtaactggaagagaaactgttcaagctttgtatgattacacagaaaaatctgccagagaagtttcgatgaagaaaggcgatttgcttcacctgttgaattcaaataacaaggattggtggaaagtcgaaatccacgatcgtcaagggttcgttccggctgcatacgtaaagaaagtcgatgctggcttgacagcttcgcaacaaaatcttttggatagcaactcgatctccgccagacagaaccagatcaaccaacaatatgacaggcttctacagttggccaacgaacgtcgcaccaaactcgacgaaacagtcaaagcctatgtccttgttagagaagcagctgaattggccggatggattaaagataaagaaatgcatgcccaagtcgaagatgttggagaagacctagaacaagttgaagttatgcagaagaaattcgatgatttccaaacagatttgaaagcaaacgaagttagattggcagaaatgaatgaaatagccatgcagcttgtctcgcttgatcagaccgaagctgctatgaagattcgaacccaaatagacgatttgaataccaagtggacagacttgcaaaagttgacatctgaaagagccaaccaattgggatcagctcacgaggtccaaagattccacagggatgttgatgaaaccaaagattggatcactgaaaaagatgaggctttgaataacgacgatcttggtaaagatttgagaagtgtacaaaccttgcaaagaaaacatgaaggattggaaagagatctagctgccttaggcgacaagatcaaacaattggacgacaccgccaaccgtctggtaaattcccacccggaaagcgccgaacaaacgagacttaaacaagaggaaatcaccgaactatggacccaattgaccgcgaaagcgaacagccgcaaggagaaactactggactcctacgatctccaacggttcctcaacgaccatcgcgatctgttggcttggatcagctctatgcttggattggtcagttccgaagagttggccaacgacgttactggcgcagaagctttgatcgaacgccaccaggaacatcgcactgaaatagacgcacgcgcaggaaccttccatgcactcgaacaattcggtcaacagctgcttaactcgaatcactatgcaagccccgaaatacaagataaactcgaaaaactcaataaagctcgtgctgacttggaacgagcttggatcgacagacgcctacagttggaccaaaacttagaactaaatcttttctacagagattgcgaacaggctgaaaactggatgtctgacagagaagccttcttggcttctgacgatgtagatagcaacggagacaatgtcgaagcattgatcaagaaacacgaagatttcgacaaagctattaatgcccatgaggaaaagatcgctgccttgcagatgttggctgatcagttgattgaaagggaacattatgccgccaaaccaattgatgacaaacgtgctcaagttttggatagatggcgtcatctcaaagacgctcttatcgaaaaacgttcaaaattgggcgaaagtcaaaccttgcagcaattctcaagagacgcagacgaaattgagaactggatagcagagaaacttcagttggccactgaagagagctacaaagaccccgccaacattcaatccaaacaccaaaagcaccaagcattcgaagctgaattggcggctaacgcagatagaattcaagctgtgctggccaacggtgccaatttgatcaacaagcatcaatgtgccggatcggaagaagctgttcaaaaacgtctcgagtccattgccgatcaatgggagttcttgacacagaaaactacagagaagtcgcttaaacttaaggaagccaataaacaaagaacatttattgctgcagttaaagatctggacttctggttgggtgaagtcgagagcttgttgaccagcgaagatgctggtaaagatttgacttctgttcaaaatttgatcaagaaacaccagttagtggaagctgatattcagcatcatgatgacaggattaaagatatgaacgaccaggcagattccttggttaagagcggacagttcgattcaacatctattttagaaaaacgagattccatcaattcaaggtacgaaagaatcaagaatttggctgcccaccgacaagccaggctcaacgaagctaacactctacatcagttcttcagagatatcgctgatgaagaatcttggatcaaggaaaagaaacttttggtgggttcagacgactatggccgcgacttgaccggtgtccagaacttgaagaagaaacacaaacgtctagaagccgaactcgcttctcacgaacccgctatccaagctgttcaagaagccggcgaaaagctcatggacgtctctaatctgggagtccccgaaatcgaacaacgtctcaaggccttaaaccaagcttgggctgaattgaaacaattggctgctaccagaggacagaagttggatgaatctttgacttatcaacagttcttggctaaggttgaggaagaagaggcctggattagcgagaaacaacagttgttgggcgtcgaggattatggtgacactatggctgctgtacaaggattgcttaagaaacatgacgcgttcgaaactgacttccaggcccatagagatcgctgcaaggacatcagcgacgatggtcaacgactcgtttccgaaggcaaccatcattctgacagtattaaccaacgttgccaacaattgcaaaccaaactggatcatttggcggctttagctggtagacgcaaggctaagctagtagacaattcggcctatttgcaattcatgtggaaggctgatgtagttgaaagctggatcgccgataaggagagccacgtcaagagcgaagagtttggaagggatttatcttctgttcagaccttgttgactaaacaggagacctttgacgctggtcttactgcatttgaacatgaaggtattcaaaacataactgcacttaaagatcaactaatttcttccaaccacgaccaaactcaagctattgtccaaagacatcaagctgttatttccagatggcaaaaacttctaaacgactctgacgcacgcaaacaacgtctgctgcgcatgcaagaacaattcaaagaaatcgaagagctcttcctcatgtttgccaaacgcgcgtccgcgttcaactcctggttcgagaatgccgaagaagatttaactgatcccgtacgttgtaactcaatcgaagaaattcgcgcgttgaaagaagcccattcccaattccaagcttctttgtcaagtgcgcaagccgactttgacgggttagccgcgctggatcaacagatcaagatgttcaatgttggacccaacccttacacctggttcaatatggaagcgttggaagacacctggaggaatttacagaagattatagccgagagggatgttgagttgaacaaggaggcgcagagacaagaggagaacgataagcttagaaaggagttcgctaagcatgctaatgctttccaccagtggttgacggagacacgtacctccatgatggagggctcaggttctctggaacagcaactggaagcgacgaaacgtaaggcagcagaagtacgtgctcgtagatcagatctgaaaaagatagaggacctaggagccattctcgaggaacatctcatcttggacaacagatacaccgaacattctactgtcggtttggctcagcaatgggatcaactggatcagttgggtatgaggatgcagcacaatttggagcaacagatacaagcgagaaaccagtccggtgtgagcgaggatgccctaaaagagttctccatgatgttcaagcacttcgacaaagaaaaatccggaaaactcaaccatcaagagttcaagagttgtcttcgagctcttggatacgacttacctatggtggaagaaggccaacctgatccagagtttgatgctatactggatgtagtggatccgaatagggatggtcacgtttctctacaggaatacatggcctttatgataagcaaagaaactgagaacgtccagagttccgaggaaatagaaaaggcgttcagggcaataacggcaggagatcgtccatatgtcaccaaagaagaattatatgccaatcttaccaaggaaatggcggactactgcgtggcgaggatgaagccttacgtagagccgaagacagaacggcccatccagggcgctttggactatatcgagttcacacgcacactttttcaaaattagttaggttaggttccgcattagtcgcttactcttgctaaacgttagatagacagtataatattattattgcaataagaaacaaatatttattgaagattatatatttcagattatatatatttattgttccgtatattcttttaacgatttttatgagtgaactgttcttacactatttttatgggctttgtggctttaatattgggacaagatatatttaaaagtgttcattttaatattaatatagttttgtatcttttaattattgtacttgaggtgtttctcaaatatataactttgcttcatt

SEQ ID NO: 3 - DNA, 7188 bp, Diabrotica virgifera
  Annotation=Clathrin
  SmartBlast Evalue=0; Info=Clathrin n=1 Tax=Bombyx mori RepID= B7XFU6_BOMMO
cgccatattagatgtttgattcagctagctgtcagtttagtgaaaaaattgtcattttccttaaatttccgaaaacgtttcaataagtaaagtggaaagtgtttaaattttattttgtgttttgttgcaaagaaaaagcaacatgacgcagcaactgttacctatcaagttccaagaacatttgcagcttaccaatgttggtatccatgctaccaacatcacgttcgccaatctcaccatggagagcgacaagtacatctgcgtgagagaaaaagttggagagacgtcccaagtagtcatcatagatatggccgatacggccaatcccatcagacgaccaatcaccgccgaaagtgctattatgaatccagcatccaaagtcatcgctcttaaaggtaaagcaggcgtagaaacacaaaaaacccttcaaatattcaacatagaaatgaagtcaaaaatgaaagcccacaccatgtctgaagacgtaattttctggaaatggatcagccccaatacgttagcgctagtcactgaaacttcagtgtatcattggtccatggaaggtgattcaattccacagaaaatgtttgacaggcattcttctcttaacggctgccaaatcatcaactaccgaacagatcccaaacaaaactggctgctactggtcggtatcagcgctcagcaatctcgcgtcgttggtgcaatgcaactgtactcagtagaaagaaaatgctcccagccaatcgaaggacacgccgcttctttcgcgaccttcaaaatggaaggaaaccctgaaccatcgactctcttctgttttgcagtgagaactttacaaggaggaaagttacatattatcgaggttggtcaaagtccagcaggcaaccaatcgtttcctaaaaagacagtggatgttttcttcccacccgaggcccaaaatgattttcctgtagctatgcaagtgtccgctaaatacgacgtcatttacctgattaccaaatacggctatattcatatgtatgacatcgagagcggcacctgtatctacatgaacagaatatctagtgacacaatattcgtaaccgcaccccacgaagctacgggaggaatcattggtgttaatagaaagggtcaagtcctatctgtctcggtagatgaggagagcattattcgatacatcaacaccgtcttacacaatgctgacttagcgctgcgtctagctacgagaaacaatctttcaggagccgaagaactgtttgttagtaaattccagatgttgttccagaacggacagtacgccgaagctgctaaagtggctgccaacgctccaaaaggaattttaagaaccccagctacaattcaaatgtttcaacaagtcccgactcaacctggacaaaacagtccccttttgcaatatttcggtatacttctagaccaagggcaactaaacagatacgaatctttggaattgtgtaaaccagttttgttgcaaggtcgcaaacagcttctagaaaaatggttaaaagaggaaaaattagaatgttccgaagaattaggagacctagtcaaacaggcagatcctactctggctttatctgtgtatcttagagctaatgtacctgcaaaagttatccaaagctttgccgaaactggccaattccaaaagatagtcctctacgccaaaaaagtgtcttatactcccgactatgtattcctgcttcgccaagtcatgcgcaccaatcccgaccaaggcgcagcatttgcagggatgttggtagcagacgacgaacctttggccgatatcaaccaaatcgtggacattttcatggaacaaaacatggtgcaacagtgtactgcgttcctgttggacgccttaaagaataacaggcctactgaggggcatctacaaactagactattagaaatgaacctgatgtccgcaccgcaagtagcagacgccattctcggcaacaacatgttcactcactacgaccggccccacgtagcccagctctgcgaaaaagctggtcttttacaaagagctctagaacactacactgatttgtatgacatcaaacgtgctgtggtacacacccacttgcttccagctgattggttggttaacttcttcggaactctcagcgtggaagacagtttggagtgcttgagggccatgctgaccgcgaatattcgacagaatttgcagatttgcgtgcagatcgctaccaagtaccacgaacaactcaccactaaggctttgatcgatttgtttgaaggatttaagagctatgagggtttgttctatttcctcggctccatcgtcaacttctcccaagaccaagaagtgcacttcaagtacatccaagccgcatgcaagactggccaaatcaaagaagtcgagcgtatctgtagggaatcaaactgctacaatcccgaaagagtcaagaatttcctgaaggaagccaaacttacagatcagttgccgttgattattgtctgtgacagatttgatttcgtccacgacttagtgttgtatctatatagaaattcgctgcagaaatatatcgagatttatgtccagaaggtcaatcccagccgtttaccggttgtggtaggaggtcttttagatgtcgactgttccgaagacataatcaaaaacctaattcttgtcgtcagaggccagttctccactgacgaattagtagaagaagtagaaaagaggaacagattgaaactgttgttgccctggttggagagcagagtacacgaaggatgtgtcgagccagctacgcacaatgctttggccaagatctacatcgattccaacaacaatgccgaaagattcttgaaggaaaatcaatggtacgattcccgagttgtgggacgttattgcgaaaagcgcgatccacatctggcttgcgttgcttacgaacgaggccaatgcgacagagaactgatagctgtatgtaacgaaaactctctatttaagtctgaagctcgttatttggtccgtagacgtgacggagaattatgggctgaggttttgaacgagagcaatccttacagacgtcagttgatagaccaagtagtgcaaacagctttaagtgaaacccaagaccccgaagatatctctgttaccgttaaagcattcatgacagctgatttaccaaatgagctcattgaattgttggaaaagattgtattggatagttctgtgttctccgagcatagaaaccttcaaaatttgcttatcctaacagcaatcaaagccgatgctacaagagttatggactacatcaaccgcttggataactacgatgcccctgatatcgcgaatatagccatcaacaaccatctctatgaagaagctttcgctattttcaagaaatttgatgtcaacacctcagctattcaagtattgatcgaacaagtcaacaacctggatcgtgcttacgaattcgcagaacgttgcaatgaaccggccgtatggagtcagctggccaaagcgcaactgaaccaaggcttagtcaaggaagcaatcgattcttacattaaagctgatgatccttcagcttataaggacgtcgttgagaccgcttcgaaaaataatagctgggaggacttagtgcggtatttgcagatggcaagaaagaaggccagagagagctacatcgaatctgaattgatttattcgtacgcgaagaccggaagattggctgatttggaagaattcatcagtggacccaaccatgctgatatccagaagattggtgataggtgctttgacgacaagatgtatgatgctgccaagctactctacaacaatgtatccaacttcgctcgtctagctattactttagtgcatctaaaagaattccagggagctgttgacagtgctaggaaggctaatagtaccagaacatggaaggaagtgtgttttgcttgcgtcgatgccgaagaattcagattggctcagatgtgtggtatgcacatcgtggtacacgctgatgagttgcaagatttgattaattattatcaagatagaggatactttgaagaattaatcggcctattggaagcagcattgggcttggaaagggcacacatgggtatgttcaccgaattagcaattttgtattccaaatataagcccgccaaaatgcgcgaacatctggaactcttctggtctcgagtgaatatccccaaagttcttagggcagctgaacaagcacatttgtgggctgagctagtgtttttgtacgacaaatacgaagaatacgataacgctgtgttagccatgatggctcatccaaccgaagcttggcgcgaaggtcatttcaaggatattattacaaaagtggccaatatcgaactttattatagagctattcaattttacttggattacaaaccgctgttgttaaatgaccttttgttggtgttggcacccaggatggatcatactagggctgtttctttctttacaaaaacaggacacttacagttggttaaatcctatctccggtctgtgcaaaatttgaacaacaaagctatcaacgaggccctcaactctctacttatcgaagaagaagacttccagggtctgagaacgtccatcgacgccttcgataacttcgacaacatcggcttggctcagaaattggagaagcacgaactgacggagttcagacgcatcgccgcctacttgtacaaaggcaacaaccggtggaagcagagcgtagaactgtgcaaaaaggatagactatttagagacgctatggagtacacttctgaatctagaaatcaagaattggccgaagagttgctggcatggttcttggataggaaggcctatgattgtttttcggcatgtttgtatcactgctacgacttgttacggcccgacgttatccttgaactagcatggaaacacaacattatggacttcgcaatgcctttccttattcaagtaactagagaactgacgacaaaagtagaaaagctagaacaatcagatgcccaacgacaaagcgaggctgctgaagaaacgaacaagccaatgatgataccagaaccccaacttatgctaacggctggccctggcatgggtattccaccccaacagtatgtacctccccaaggctacgcgcagccaggctacgccccgcaaatggcttaccagggatacccaggcatgtaatataaggccccttttacagccaactgtataggaaagtggaattagttttcaagttaaactgaggagctagtgctaaggacaatagagaagttataactaaaaaaatagcggttccaattcgtttcgtgtattatgaacaacgttactttctaaaagaagaagaatatattgaggagttcgttttaaaattatgtacaagtagaagttttaatacttggttaactaaaaacgttacatttttttgagattacaaataactgaataattgaaaatattacttacaattttatgcgaactgctcgataaatttctcaaaaatagcaaaacaaataataggtttattgaagtgttacagaaaatttaggcatttcctttaaatcaaataaatgtttcattatttgtgtgaaaagttatttattaacattattcatcttttgctaaaaaacagttgagattattgcaaaatgttattgcattttgaaagtaaagatgtaaatgtgttacaaatgatctatttgtagttttgtcatcattatgttttgtttttccgtccattgttgagtatatttcttcataaataaagtatcagatgatgtttatatataatacaataatttttattctttaatcgcttcaatatttgttataatgtcttcaatttcaacatattgttttttttgtcgtattggtctttttagtgtttcctgccacctctaaccaattattaggcgattttacatgaggattaagcctacagatgtcaaaatggcgtcatatctatcgaatgacaactgacagttgaagtgtcatatttaaattatgatcatactgttccgtctttcttcgtctgtaattctaattcgttcataacgatctacctactcttttcatttttttttgtgtagttatttaggcatttttaagtctacgactgtcaaaatagtgtcaactgacaagttggaagtgtcatacttaaattatcaccattttatcctgactccctttgtcttcaattttgatttcataataatttttatttcagtgcccacttgaacctttttttataatttacatatctcatagtcatttttaggcgtttaacttacaacattgtttccacacacattttccagcttcgatatcagttattgatttacaataatttaaatttgctcctttatacaaatgtaacaacccaattccaacccttttattaattttctttttgttttgataagatttatttgcaacaaacaattctagcgaaggaagaatttccaacaagttaaaaacaaacttatttcaattgtcaaaccttttaattttctttcgaaatcttgatatttctttcgctagaataattgccccaaattgaatttcaggtactttccttcgagtcaagatctggtcataaccccaaaaaagacagttgacgtgtcgtgtcatgacactgacgtttgaacacttcaattgtcagttgtcatggaagaccgttggtagagataaaatgaccaaattttctgtagcacattatgtaagcttaaagaataaatgcttaaacaaattctagttaaatacaatcaatcttgttgaactgtttgttgtagttttaattcattcgcatcattttcggacattaggcttcgttttgacgggacacttgatttactttttcagttggagaatgtatatatatttttatgtactagcaccccactttagaatgtatataatctaaagaaattattttgttttccgagagaattatcaatgcgttcttttgtttgttttctttttttttagtccgtttatcattcctttatttaaacatagatatatgtatatgaagtgactatttaacttatattattatatgaattatatgaaagtgattcttcaatgtttaataaataactaaattgttttttttattcattattattcttatttatgttaagattttgcgaatatattagtaaatatatgtaaag

SEQ ID NO: 4 - DNA, 3738 bp, Diabrotica virgifera
  Annotation=Eukaryotic translation initiation factor 3 subunit, putative
  SmartBlast Evalue=0; Info=Eukaryotic translation initiation factor 3 subunit, putative n=1 Tax=Pediculus humanus corporis RepID=E0VV02_PEDHC
taatatctgaaattttattaactatatgggttaattagcacacagcactgccttatcaacgagttcaagccagttccgcattaaaacaatgattactataaatgaaaaccctcgtaacctgtaggtaaataaaatatcggtataattgtgtaacttaattctctagtctagattatataatggcttaacgtctccttccaacttgggaccagccctcctcgccttctggctgagattgctgctcgcgagctggtttttctctggtcatcggagttccccttctatcgtctctcttagaatcatctctacgatcggtctctcggttagcactcctccatgctgattctggagcagcttctcttctcataggagtagaacgacggtcatcgtcagtctttctacgccaagtaccttcgtccccgcctcttcggtccctgtcgtctctacgatcacgatcgtctcggcggtcccggttatcatctcttccgccacggtcatctcttctctctctatcatctctacgctccctgtcgtctctcctatccctatcatctctacgatctctgtcgtctctcctatccctgttatccctgtcgtctctcctctccctatcgtccctgcgatccccacgattatcccgattatctctcgtgaatctgacaccaccttctctgtctctgtcgccaaatcttccgctgtcgcggttgccaaatcttccgccgtctccgccgcgacgttcaccttggcgatcgtctctgcgatcttcccttttatcgtcattcctccaagaagaagtagtggtgttgtcgccttttgggggttcttcagcatttgatcggaaacgagatgctctccaaggttcatttttgggttcgtcagcaggtttctcgtccctcctccaagaagagctattcttggggtctttcctccaagaatcttttcctttgtcgctgctttctttctccattgctaatttcttttcgatttcttcctctttagctttctgcattgtccaagctctatccaaactctcttgatgttccttcttcttcctttcttgttcctcctttagtgcgcgttcttgttgctcctgttcttttctcgctatttcctctaatctctccctttcttcttcttcgcgacgtctcttttcgttggctctacgttcggcttcttcttccttttctttaatatatgtagcacggcgctcctcttttctttggatctttctttccaaaagcctcttctttctttcctcgctcaacatcttctcgaattccttaagattgtcttcgtagacaatgtttctctccttctttaatttcgagatgaattcatctttgtcgactttcatgcgtagcaaacggtctctcgttgcgacggccagcttgcgctcttcaattgctgcagcgattcgctctttctcctgttgctcccagaagttctgatcctgtaattgacgttcttgcatattggcttgaagtagagggatttcttccaaccgcttggcacgctcgaaatagtctaccttcttttcttgagatttgagcttggcttgaagttcgcgacgttccttttgtagctcttctgcttctttcaccgctatttggtctgcatcaagctttttgatatcgtcttcatccattttcttcagaatcttctgaccatgaccagtctgtctgatttgttgtagtttttcctttaagtgtctgtctttaacctgctggatttcatttagagcacgtttccgctctctttcttctctttcttggtccaatcgtttttgttcggccagtaagtgctgccgttgcatttcttccaatcttttctgctcctcttcttccctgactgtattcaaacgctcaatatattcctttctgtcctcaataatcttgtgcctttgtaaaattttctggtgttctctaacctttgtttcgtgataattctgaaccataacagctctaagtttttcgcgttcaagcttcttcttattaggattaatgacttgtatggcttgattcaatacagtagacatgttaataagttgatttctgacttgctcactaggcataacttgcaaagtgggtccctctggtttgtcctctctttggctttcactcaggtccattccaaagtggatacagtctttgccatgatcaatacgaatttgcatatcattgtgtctcacacaatcaaccaaaagtctctccagatgaaaaggtgtagtaaatttggcaatctggatcaacctagcaaattctatggtctgatagacttgtgctatctgtctcactagacgcaccagagttacatcttgtaaagctggcacatattgttggagggctgcattttcttcagattcgagagatttgattacctcatgcactctctgacacaatagtaaaggatggaactccacttccagccaattgtacaaatcttgtagttgtggacttgccaggttcacaacattaactcttacaagatctctcaaaagactagctctagtaggtggttgaatcagccccaataaaacagctaaacgctgagccttctctaaaggtgacttgtcggtttcaatgaatctatcaaactcagggtgagcggaaggcaacggtattgctagtgtagcgattaataccctacaggccattctttgtaattcctctggagtgatgttcttcttcatctcctttgacaactggaagaacttgaacaaagcagcagcatggaatagataattaccagctttccagaacaccatggctagtttctggtaatagtttgccatggtttttggtactggactcttcttggacaaattcatcaagttatggatgtcttcgatggccttgtaggcttcttgccataactccatctgaatagcaaaatcaagttgatggagcctcgtttcaagattaagttgttgggtttctggtttagacatagaaacatttgccatttgtgttggtaatttgcagatatcctctaaatgtttcctcaatttatcacataattttctaaattctgtttttctattatatttcaaacaaaactggaaagccatcctggctatatcatgatacaagttctcaacatgtgcatttgtacgcaaaagttccaaacattgacagtaagattcccaaaggaacttaacccacggagtaagaattgtacgatctgaacggtcttgggcatcttctccagaaacagcactcaacaatatactttcaggtgtagccaaattatctaaatcatcgatatcaataactgcttgtgctgactgttctctagcattctctgttctttcttctgccatccgcaaataccctcttataacattttcaagtgatcctacattcactgactggaacatgttcctgtattggaaaagaccttccttggcaatgtgagattttttcagttctacacatagatccagatatttgaacataataggttccaaaacggattctgaccaattgtacgcccattttttattacgaaaaacttcttggagagtatcaagggctctagctggttttccaacttcgatgaattcattcgctcgctttaaagcgttttccggacgctgaccgtatcgggccatctttactgtgtttatttgttgtattcacttcacatttaaatatatagaatagtaaataaaactattatcttctgaaatttcgtcaaagcaaacgtcagttgaaagacaaaatttcaggcaaaatggcc

SEQ ID NO: 5 - DNA, 3450 bp, Diabrotica virgifera
  Annotation=Lipin
  SmartBlast Evalue=0; Info=Lipin n=1 Tax=Aedes aegypti RepID= Q17AT3_AEDAE
aaacgcgtcgtgaaacatacgtgaactgatattaaaaatactcattttatttttgtgacaaaataacgagtgataaaaatattggcaactaactttatcgtttaactgttaccacgatctcgtggaaaagtgattataaaatgcttgtgatatggaagacagtatagagaatttgttttaatggagtgtgtgaatattagaactgatcttagaaaataagccgtccaaagtcagcaaataatagattcggaaagataaaagtagcaacacaaaactgccaagatgcacgggatgatgaaaattttttccaatttcaaagatttctacaatgacataaatggtgcaacgttaactggtgctatagacgtcatagttgttgaacagcctgatgggtcctataactgttctccgttccacgtgaggttcggaaaattgggggtgcttagaagtagagagaaagtggttgacatagaaatcaatggggaaccacaagaaattcatatgaagttaggggagagcggggaggcatttttcgtagaagaattagaggaagacgatgatgaagaaattccagaacacttagcaacatctcctataccagtttctgacttcgaaacattatttaaaaaacaaggaaggcgtctcagtctggaagacatctccaatctgggattggaaaacgaagaaaatgactacaaaacgcgtcgcaatacggcagacaacgaaagtaacaagatgcgagaacgcaacttcatcagacgacaactggtcttgggtaacctagaaataaataatgaaaattcagcagaagaaatgacactatctataatatccggaaagctcagtagcgaagatttaagcaagagccacaacgacatttctgaaactatttttaaaatggacagcttggatatagatatcagtaaaaccgaagaactaaaatctgaaaatctggtatctcctgtatcaaaccttcctaaaatcgacgatcctacaaacgaaagtaaaagtagtaagaaaaggcgaaagagagtacggcgaaagaatgctccaaagaaatctagcagcataaaccaaatgactagcagccagatatcagaaaacctggaaactaacgacaccattactgataggagttccttggatagcaatgggtccgatcctgaattacaaggaaaatcatccaagaaaaatgatgacaacgttcttcgcgtcgatacttcccatattaagaaaatagacgcagatttccatttctttagtgacacggaactgacaaaacccagtattggagattgcagaactggttctgtcgaaaatgttgaaaacgtccagtctgattcagaaattgaagttaaagcaaggaaagatgagcctcttgacaacgcgaagagctgggaatggggaggcttccctagcgtctcccagactaactctccagtgagcgacaatcccagacaagaagaacgtaggtcgatgctaagcggtatgttctcttttatgcaacagaagcatggtgctcaaaatcctttagaggggggaatgtacttgtcagatattacttccggtactgtcgatcaagaagtagctcagatctatttcagtacgaccaaggacagaaaagacgtggaggtggattgtgaatcaggaaatggtccttcattgacgcagagtcccaatagtgccgatggatgcaagagtatcgactccgacttcgaggaacagaataaattagcacagtcgttctcccaggagatatcgctttcgctttgcgggtgggatccagaaccgaactacaacagatttttggagaaggtagtgaaattcagcgatttgtgcaacaatcccattctattcgagagtcccagcttggtagtaaggataaaggacaaatactacacgtggaaggtagcagctccaattattaccagtattatggtttacggaagacctttggtacaatcatctgtggatcagttgtgtagtattcatatgccgattagtactccgcaggagctgaaagaaggaccaaagcaggaagttggaagaagaagttggtggagctggagacgagggggtgcttcgagagaaaccactcctgcccctgaaaacgagaatgacgcactcaagactgccgataccaaagacgttgttatagaagtagacgacgactccaaattagaagacaaaaatgaagacgttaacgagcaaattgatgtacccagatctccgagctctagctctgataagtataggaaaactttgagactgacttcaaaacaaattgttctattgaatttgcgggatggtatgaatgaagtggaattcagcgtgactactgcatatcaaggtaccagcagatgtcagtgtcatctctacaaatggaagtgggatgacaagatcgtagtatccgatattgatggcaccattacaaagtctgatgtattaggccacattttacccattgttggcaaggattgggcacagaccggagtggctcagctatttaataaaattgaagataacggttataaactactgtatctcagtgcgagagccattggtcaagcaaggatcacacgagactacttgaaatctatcaaacaaggagatctgagcatgcctgacggtccaatacttttaaatccaacatctttgataactgctttccacagggaggtgattgaaagaaaacccgagcagtttaaaatttcgtgtatgtctgatataaaagctctatttccaacggattctaatcctttctatgctggttatggaaacagaattaatgacgtttgggcgtacagagctgtaggcataccaatagttagaatattcaccatcaatccaaaaggtgaactcaagcacgagttgacgcagaccttccagtccagctaccccatcatgaccgtcatagtggaccagctgttcccatctcgttccgaagccgccagtgatttctcccaaaacgtttattggcgagacccaatccccactatcgaggaagtacccgaaatctaaatgttcaaaacaaaattacggcattatctgcatttatatatgtaaacctctgtgattagcttcaaacagtgtgtgctttttatcgatgattccattgacatttagtttttgtacggacgccgacattagtagtgcaggcattgttgttttagtatttacctaatttgttataataaaagaaagacatgttcacatctgtgttcataatggattagacggtagacatttggccaaattacacatatttgaacataatttgtacatgtgatattaattgataaaggtcaatcaaaggccaataataagacattaatctccatatgccagtggaatattagaccataagatgaatcatatgaagaacgcaggagccgcgttgcaggcacataaacaaagtttgtcaaaacgcgggagccgcgttgccggcac

SEQ ID NO: 6 - DNA, 2945 bp, Diabrotica virgifera
  Annotation=Phagocyte signaling-impaired protein
  SmartBlast Evalue=1E-172; Info=Phagocyte signaling-impaired protein n=3 Tax=melanogaster subgroup RepID=NAA25_DROME
gtttcggagttccgctaaaaaatcatggcggttagttttcagtttcagtaaacaaaaaaactaaaagaaaaatcataataagtgtagtgcagttcaataaaatattacatcatttatcatataaaggagttatagatatcatcggtaccccatatcaaaagttcttgtacataacctatacttcctccaaggaataaaatgtctagatctcaagctaattcacacgtgcaacaggataactctgtggtagaaagaagattaaggcctatttacgattggctcgatagtggaaataacaaaaaagcactgcaggaatgcgacaaggtgttaaagaagactccgagcttgcaatgtgcgaaagcattaaaggctctaactctgcgtcgcataggcaaagatactgagtgtaatgcgattttggatatgttgactaaagaaataccatctgacgatgcaactttacaagccatggctctctgttatagggagatgcaagaattggagaagatctgcaagttatacgaaatcgtagtaaaaagcaatccaaacaatgaagaactgcacacacaactctttatgtcatatgtcagaatcggtgacttcaaagctcaacaacaaactgcgatggccctatacaaaagcaaaccgaagaacccttattattgctgggcgataatgagtgttatattacaagccacacgaggagaaggctccgaagatccccaaaaacgaaagctgttgctgagtttagcagaacgaatgttcactaaattgattagtgataataaagtcgatgctgaacaagaggtgcagttgtacgttatgatactaaatcttctagggaagtatgaggaaattatagatattttgaatggacctttgggtgttaggatgcaatgtgctaatataccacaggttaaactagaatacctcaaaaagctaaacaggtggattgaggttaatctaatttgtaaggggatcctaatttacagtgtggataggtgggacatttggaaagaatatattaagtccgtttttgagctcatggtgatcaatcagtcagctccaagtactcctgaaaaaattggggaggaaatagaggttcctgacgataccgcagaaaaggctcatgagttcatttgcggtattattgaaagcggaacaggaaatgagtacttacttcgtggaccgtacttggccagattcgaactttgtctaaagttaaacgagaggaacatgaagtatgacattcttggcgatcttatggaactgtttattgaatatttccgtaaatttggacacaagcagtgttgcgttagcgatttaaggatatatctgaatttgttggattcggaaaagaagacagaattagcctctaggttaatcaaggacgttggaattagctcaactagtgtaccacaaacagaaagacaaatgcaaaggcacatatccgctttacaactttcaaggctgtgcggtggccatcggaacctccaaccggatcatctgagagccctaataaccgccttatcccttcattatcaacacggttttcaaacgtacggcgaaaacctccttcctacagacttaggtccgtctgatccgtatgctctgatgtcagcgcacgtgttatacgatttagcacacatagagaagagctcaaattgcatacaagtggctctgaggctactagagtgtctgttgaattattctcccagtaattttcatgctaagttgttagcgattaggctgtatcatgagttgggtggaagcataagtgctcacgatatgtactgcagtttagatgtgaagcatttgcaattagactctttaggatttatccattgtgccaggttacccacgacgggactcttcacactatgtacgaatctttttgatgcgactctgaaatttttttctagtaattacaaagatagttcggatcatttgacattctcctataaatttggttcgtttatgaaaatcgatgagtttatggactttagagaaagactgaacaacagtttacattattccacagtagtcgtagataggattatcttaaatttggtggaatgtatgtcgttggaaacgttatattctttagccataactccacaggattgtaacataaactggaaatcattaatcgacaaccacgaccttagtgcatatacaacttgggacccagaacgaataaatggccaacccgaagactggcaacaaaccaaagacttgttcgaacaggacatatggtttctaaaactacgatcttcggttctactcggaatagcacacggtatagaaattgtcaaatccatagacgggaccagaagtgaatgtataaaagctttgcggaaactgttagacgagtggaagagtatacatgaagaaattttagataaaaaaattgctccaattcaacagggtctattgcctttaccattaccttccaggttgcatggtgcgttggaggttccatatttcacagtttttagttcatttttcgaatttcttataagtctgactagtgacgataacgaatctgtagagaaatgcacgtcgtgcgttgtggacgagcttaccaaattgactgaagtgttgaagaaccatactttaaagaaaccacacgattttcttgacaagcggaaatctttggaaatagcagttaattgtgtagagataatcagcatatcatctgtaatctgtgttctttgcggcgacttgataaagccgctccaaataaagaaaggccgaaaaaaagtctgccgagccaaaaagcaaggaatacatacagaaaatttctgaaaaattaaaaactgaaatgaatagcttttgtgatattatacaagattggtcggagacgtatccagaggaatcagtggatgtaaaatttgaaaatttaaatttgaatggaaatgataacattgcggagaagatacggt

SEQ ID NO: 7 - DNA, 2875 bp, Diabrotica virgifera
  Annotation=Coatomer subunit beta', putative
  SmartBlast Evalue=0; Info=Coatomer subunit beta', putative n=1 Tax=Pediculus humanus corporis RepID=E0VFG2_PEDHC
gtgatgtgtttataattcgtgtcaatttagtgaaatagcattcaattttttgtataagatctcttcaaaatgccacttcgattagatataaaaagaaagctaacagctcgctcagaccgggtaaaatgtgtggatcttcaccctacagaaccttggatgctgtgttctctttacagcggaaatataaacgtttggaacaccgaaaatcagcaactggttaagacttttgaagtatgtgatgtacctgttcggacagctaagtttttgcccaggaagaactggatagtcagtgggtctgatgatatgcagattcgagttttcaattacaataccttagatcgggtacattcttttgaggctcattcggattatgtgagatgtattgtcgtacaccctacacaaccttatatattaacaagtagtgatgatatgcttatcaagctttggaattgggaaaaagcatgggcttgtcagcaagttttcgaaggacacactcattatattatgcaaatcgccataaatccaaaagacaacaacacatttgccagtgcatccctagatagaacattgaaagtatggcaattgggagcgtccacagcgaatttcacactagaaggtcatgagaaaggcgttaactgtgtggactattatcacggtggagataaaccttatttaatctcaggcgctgatgatagattagtaaaaatctgggattatcaaaacaaaacttgtgttcaaactttggaaggacatgctcaaaatgtaaccgctgcatgtttccatccagaacttcctgtagctcttactggaagtgaagatggtactgtcagagtgtggcatgccaacacccataggttagaaagtagcttaaattatggctttgaaagagtatggactattttctgcctaaagggatccaataacgtggcattgggttatgatgaaggtagcattttggttaaagttggtagagaagaaccagctgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatataccctcagacaattcaacacaatcccaatggccgttttgttgttgtctgtggggatggagaatacataatctacacagcaatggctttaagaaacaaagcgtttggtagcgcacaagaatttgtgtgggctcaagattccagcgaatatgccatcagagaatccggatctactatcagaatttttaagaatttcaaagagaagaagaattttaagtccgattttggagctgaaggtatatacggtggataccttttgggagtcaaatcggtttctggtttgactttctatgattgggaaactctcgatttagtcagaagaatcgagatacaaccaaaagcagtttactggtcagatagtggtaaattagtatgtttggccacagaagatagctactttattctttcttatgattctgatgaagttcaaaaagccagagataacaatcaggttgcggatgatggagtagaatcggctttcaatcttctaggtgaaataaacgaatcagtgcgaactggtctctgggtaggcgactgttttatctacacgaattctgttaatcgtatcaactacttcgttggaggtgaactggttacaattgctcatttggaccggcctttgtatgtcttgggatatgtgcctaaagacgatagattatacctcgtagataaagagttgcgcgtagtaagctaccaattacttctttctgttcttgaatatcaaactgccgtcatgagaagagactttccaacagcagacagagtacttccgtccattcctaaggagcacagaacgagagtggcacatttcttagaaaagcaaggcttcaaacagcaagctttggccgtaagtacagatccagagcacagattcgagctggcagtagcattagaggatcttaatatagccaaaactctagctcaagaagcgaacagtccgcaaaagtggaatcaactagcagaattggcagctgctactaataatgtaagcgtagccaaggaatgtatgcaaaaagcgcaagattatggaggcttgttgcttcttgctacgagctccggtgatgaaaatttagtccgtactctaggagaaacgacacaagctgaaagcaaacataacttagcatttttgtcacacttgttagtaggtgatttaaacaaatgtctagacattcttattaataccggtagattgccagaagctgcatttttcgccagatcttaccttcctgataagattacagaagtcgtggaactgtggaagactcagttatcttcagtcaatcaaaaagctggacagagccttgccgatcctaaaaactacgaaaatctgttccctggtttacaagaggcggtggtagctcagaaatttttggaacagcagaataaaggtttagcgcccgcaagagttgccaccaccattcctcctaatcacgacaggaatgttgtagccgaagttcaagcacaatcgaaacacgatgtaccatcatttagttcttcgtttatttcatcagaaatagaagcacaaacaaggagttctgctaaacctgaagaatcttcaaacattatacagctggaccaagatgacgacgatatcgatttagatttggacggtgtaaatatcgatgagaacattgacacgacggatatcaacatcgatgatgatttgctgagtgattgaaaataacttttttactttagtattaaatctgtatattcattcctattcttaagaaaatctatat

SEQ ID NO: 8 - DNA, 2595 bp, Diabrotica virgifera
  Annotation=Ns1 binding protein
  SmartBlast Evalue=0; Info=Ns1 binding protein n=1 Tax=Aedes aegypti RepID=Q16V35_AEDAE
agcggcgcatgactatttcattctgttgtttaataatatggcaactcaagtatcgaagcacatttctcatgtaatgttgcggttttttgtttgtctttggttataacagtgagtcagtgcccttaagttgttttatcaagcattttttaatcaaataacaacaatgtcgtacggaactttaaacggcaccaccaaagagattcccgaaaatggagacatccaggaaattgaggaggaggaggaagaggaagaaatcatccacttggagtacttcgacgaggccctccaggtccacctgttaaagtctctgaacaggatgaggaaaagtcgccacttctgcgatgttattcttcacgttggcaatacagaagtacacgcccacagatctgttctggccagcatatcgccatatctttttgaactgtttactactgaccaagatcaaaagcggaccgaaaatgtgatcacctacagattgaatggaggttttgatacgacagctttacaaattttgatcgactacgcctataccggcaagcttcgcgtccactacaataacgtaaaagcagtgttttcgtctgcaaacaacctaaaaatggaacgagtaaccagaatatgtgctcaacatcttatcaaacatctctctgctgagaactgcgttgagattagatctctgccgggtattgccagaaataaagaatttatccaacaagtggataccttcattgccaaagagtttgcagaaatcagcaaatcttccacagtgctaaatctctattgcgctcggatagaagtcctaaatcaatctcgcgaagaaatgtctctggtaaacgagaactcactctgtagactagttcttgagtggatcaggcgacagatcagcgacgagcacctcctaatatctgatctgtctgaaaagacatttatgttgtacctcgctttagataattctctacaagactgttcaagcctcccttcgggcgatattagcgacactgagatggttcaggactacaagaagctttcgttgaaggacaaacagggagtgtcgaaaccaaaaagaaaagtcctcggacaaccttctaaaccacgggtgttaatttataatagagagatcggagaagaattagataatgaaatggaacctgattggaatcttatagcgacaaccgccgtaagtgaacacagctttttgggtttggtcaccttagctggaaagctgtctacactttccatacaattaaagttaaacacaccttctactccttctccagtccaaacaccagatgccagtagatctgctagtgaagacaaacctgatctctattgtgcggtagctaacatgttatgtcataggtgtgctcatggatgtggtaattacaacaatactcttatagtgtgtggtggttatgataggacagaatgcttaagatctgcagaacaatacattccagaaacgaatacttggaaaaatcttcctccaatgagagaaagccggggtcgtttcaaaattgccgttctagacgacaaaatttatgccataggtggtagtaacgggactacggaattagattctgtcgaaatgcttgacttttccgtggggaagtgggtgaaacttccgaggatgcctctcgcccgaagcaatctgggtgtatgtacgttggacaagaagatatactgtatcggtggttggaatggacaagttggtatcaaacagtgccacgtatacaatccagaaacagccgcttggacctccatagcgtcattgaatgcaggccgatatcaagctggtgtcacagcatataacaaccttgtatacgccataggaggctcagacgcatggaactgcctgtcgtccgtggaatactacaacccggtagataacacttggcatttatccaagccgatcattacagccagaagaggctgtggattgactgtattcaacaacaagatgtacgtcatcggaggttcggacggctcacattccttgaatacgactgaaatttttgatgacgagacgcagacttggacgttcggaccagccatgacaacttcgagggcaaatatggaggtggcggttgtcggggataggttatatgccgttgggggattttcaggtaagacattcctgaacacgatagaatacttggacctaaattcgaacgagtggaccacatttgtaccaaaaggtacctgtgaatttctgaacaggaggaaacctaggagtcgcaagaactccagaaagagcatgtcagaggacaagaaatcgttaaactcccccagtacaccatcagacataatggaaaaccccatggtctcccaagcgatccagctatcaatggaagaagcagttattgacaattcgtaaaaaattagataatatatatcttatattatatctttaatcatcagtatacatctgataggtatatatttaatccagaataagtattatattcatgttgtactgaagaataactcagcttcatcttcattgattatatttttttaagaaaaatttctaaaatatcaaattgcttttcttttaggaagtatgtagtattttagttttaataaattgattattaaggc

SEQ ID NO: 9 - DNA, 2384 bp, Diabrotica virgifera
  Annotation=Eukaryotic translation initiation factor 3 subunit B
  SmartBlast Evalue=0; Info=Eukaryotic translation initiation factor 3 subunit B n=3 Tax=Aculeata RepID=E2AAT2_9HYME
cttcagttttcgtccacgcgtgtcaaaatggcgaaaaagaaaccagaggataaaaataatcaaagcgatgatgatacaaaaaacgagagtgattactcgtcgaacgaagaagaaccaaacttcagtgatcctgaagactacgaagacgatgtctctgatgaagaactcttaggtgatgttttaaaagaaaagcctaaggaaactgatggagtagaaagtgttatagtagtagatggagttcctcaagtaggtcctaatcgtattgaaaagttgaagtcagtcattgtcaaaatatttgtgaagtttggaacaatagtaaatgaattctaccctgtcaatagtgagggccacaccaaaggttatatctttatagaatattcctcaccatctgaagctgctgaggctgttaagctcactaacaattttaaattggataagcaccatacctttcaagttaacctctttactgatttttctaagtatgaccaaattcctaataagtgggaccctccagagccacaaccttaccaagggcaagcagacttgcattcttacttattggaaccggatgcatatgatcagtttgctgtagttgttgcacaaacacaagctgtgcaaatttggcagaatacacagcctgatcctagtctcattgaagctagaaacagctggagtcaaacgtacataaaatggtcacctctgggtacattcttatgtacttttcacaggttgggtgttgcattgtgggcaggacctggatttttgcaatacaaaaaatttacccattcaaatgttcaatttattgatttctcgccatgtgaaaagtatttagtgacttattccccacaaggagacccacataatccagaacagaaaaggatcatcatttgggatattaggacaggtcttgaaaagcgttcattcaatccagaaggtccaacagcatggccaatcttcaggtggtctcatgacgacaaatattttgctcgtattggtcaaaacaatgatgcccttcaagtatacgaaacaccatcttttggtcttctagataagaaatcaatcaaaattaacggcataagagatttcaattggtcgcccacagataatgttgtagcttattgggtagccgaagacaaagatgtgcctgccagtgtaactctgttagaattaccaaacaggaatgaaattagaaagaagaatttgtttaatgttgctgactgtaagatacactggcagaagtctggagattacctgtgtgtcaaggtagacaggtattcaaaggttcgcaaggagaagaatgaaaccaagtattcaggtatgtactgcaactttgaaatattccacatgaaggagaagcaaatacctgtagacagtgtagagtgcaaggaacccattcaggcgtttgcatgggagccggttggttctaaatttgcaatgatccatggcgaatcccccagcatcagtgccagtttctacgaggttaggataggacaggctcctatccttctcaagaaatttgagaaaagagcttgcaaccatctgttttggtctcctagtgggcagttcatagttttagcaggcttgggttccaacggaggtggatcgctggaatttgttgatactcacgaatttttaatcatgaacactacagaccatttccaattgtcagatgtagagtgggatccaactggaagatatgtaattactggagtctcattttggaagaccaaggttgatacaggttattggatttggtccttccaaggaaaaatcctcaagcgcatcaatttggaaaagttctcccagattctctggagacctagaccaccatcattactcagcgatgaaaagcaaaaggaggtcaagaagagcctaaagaaatactacccgcagttcgagagcaaagacaggatgcgacaatccaaggcttccaaggaacttatcgagaagagagctgctcttatggagaaattccaagcctacagagaggagaggatcgaggagtacttggaccaaaaatcaaggcgtttgcagcttagaaataacattgacactgatgaattaaatgcagagaacgttgaggaggaaatcgtagaattctttattaaagaagaagtaattccagtcgactagcaccatcttgaaagtccggtcctttccctgcgtgtgctttgttacaacacattcagggagatttaaagtgaaaacgttaaatattataatataaaaaatatttgtattttggacattgacataaatatttgttaatcaagtgtctcgttcaattaatagtgttttatatttttgacacgcgtaccatctttccaaaaactaatgaacattgttattaaacgccttgtggttactaaaataaaatatttcat

SEQ ID NO: 10 - DNA, 2361 bp, Diabrotica virgifera
  Annotation=TTC27 protein
  SmartBlast Evalue=1E-129; Info=TTC27 protein n=1 Tax=Culex quinquefasciatus RepID=B0WKB4_CULQU
cctcccaatcttgttttttgatagccgtaatggctgaacttagatttaattttatggaattgatgagagtgtctttcggatcgacttcgttatctagtacaatgtctgctaatttaatacacacgtagagcatttgctgacatgtagttgggtttttatcccaagctccttgagtatatcctctataagctctctgcagtctctgagctttgagcataatcgctggtgctaaattcgcataaagttcccagacgtacccttcattgggataaagagcagtaactctacccagcagttctctggttttctgtagatatcgttgtgaggacagaccttcacaatcattgatgtcatgacacacgtggtacactaagacatttagtacttcgacgtttagatatttttccttaaggtctaggagccgatgataggctctgattacatcagagaagttagaaatgtcgcaactaataaccaaaagattctcccacaccttccagttatcaaaattacacttcaaagcttctagaatagcttgatgggcgttcctcttgtttccaatttttatatatgcctgtgccagattattccaggcttcgaaggcttctggctcgagatgtgtataacgtctgtacgctgttgctgctgtttgccaattttctgtttgaagggctgcataacccagtcggaaccagacgttggattgtagtggattaatgctaacagatttttcaaaatgtggaatgcattcttcgtactgtttacgggcgaagagaaactggccccaatgacgttgagctctatgactacggcgtttagacaactcccaagcttttacgtaacacgtaatgtcgtctgttgcgtctcctaataagcaccacagcttgacagtaggcttctctttcaattggtccagaataacttcagcagccttatgccttaattttaatatagtgtagcatacaataacttcttcccaaagtttaatctttaaataaatatctaaggcattcttaaccaggcctatattaagcaacaaatcggcatactgtgtttcaatcttccacactggtggcatgccagttccaaagacatctgtgattcttttaatgctactggtttctctctaagcaggctcttaataatttcttcgctctgacttaatgccctttctatggttcttctagttttactttctaacttacatctaagcaataaggtaactactcgaacagcaaatgtatttttctgcttaagaattgcgtcaataaatggcataatctcttcgacttgcaattcgtctggaggtttagatattaacatatcttttataatggtaacaaatagtttctgctccaaactgcccaacttagccaaatttcctaaatcttcagtgaattctatggtattaagacggacatcatcattaattggaacatccatgggtacatcactgtcgtctatatcatctataccacgatcccttgttataatatctttttcagtaactgttactttaagggatagttgtgctatttctctctcttgaaactttgtcctttttcctaaagcacccattagatcgtaatgaatgccaagcagttcaatggctgacaagatgtgttcttttgctttggatatatgcctaaagagtaggtagagttgagctacttctatgtccaatgaggattttatgttgatacttaaatcaggattgatctggaaatgtttgtacaatctatcagcatcagagagcaaaaaaggacttagttcctctaaaatttcttgatgaactaaaatagatcgccaataccaccaattattaatcatattgtcaacagcacaatgttcaaaaatgatcttggaagtcactagcaatgccgggtatctggtattgatattaatatcttcattattaaccgacaacagtttcgcaaagttaagtgtatcgtaggtatctttacttaaataatcctttatttctttggataagtcaggaccagtgaagttacactgaacaaaattaaggatacaagatattccgaatttgagacagtctattctatcgttctcttgtaaagtgctgaagtgggtttttagctgctctacatcgaacgaccgatcaaagaatatcttccaattatcgtctgaaactaaatagatattcaagtcttccaagtcagttccattttgtagtttttcttcatctgcttttggtttttgtctagtaactaaaaggaagtcgtataacgccttttcgatgtcagccattttaaagagttaatattcacaggtaattaacgaatttttaaaaacattttaaaagtaataaaaacacatgcatcattaaacattccaacc

SEQ ID NO: 11 - DNA, 2364 bp, Diabrotica virgifera
  Annotation=Lissencephaly-1 homolog
  SmartBlast Evalue=0; Info=Lissencephaly-1 homolog n=12 Tax= Drosophila RepID=LIS1_DROME
attgtggtagttggtagtgttggtgttttttaatatctggttaaagtacgtagactgtaataatttgtgaaattctacctctgtgtaatttccttggaggaagtgtaatgctataggaatttttaagtcagcttcggaacattatcatgaaaatggttttatcccaacgccagcgagaagagcttaataaagccatcgctgattacctcagcagtagtggatacacggatgccttggaggcgttcaagaaggaggcggatatgcccggcgaggtggagaggaaattcggcggcctgttggagaaaaaatggacgtccgtcataaggttgcaaaagaaagtaatggagttagagtcaaaattgaacgaagccgaaaaagaatacatagagggcgctcccacgcgaaacaaacgtaccccttcggaatggataccgcggccgcctgaaaagttctgtctcacaggtcatcgagcgcctgtgactcgagtaatctttcatccagtcttcagtctcatggtttcggcaagtgaagacgccaccatcaaagtgtgggacttcgagactggtgaattcgaacgcacccttaaaggtcacacggattgcgtccaggatatagcttttgatgcatcgggtaaattactggtatcctgtagtgccgacatgagcatcaaactatgggatttccaacagacgtttgagtgcgtgcgcactatgttaggtcacgatcacaacgtttcgagcgtttcgttcatgccagctggcgatttcgtcatttcgtctagtagggataagaccatcaaaatgtgggaggtatcgacggggtattgcgtgaaaacatacacaggtcatagggattgggtaaggatggtacgagcatccccggacggttcgctattagccagttgctccaatgatcagagcgtcaggatttgggtagcgtcgtcgaaagagtgtaggacggagttaagggcgcacgaccatgttgtcgagtgcatatgttgggcgccggactcagcagccggacccatcaacgaagctgccggagcagataacagaaaaggagctcataccggacctttcctcgcttcggcttctagagataaaacaattaggatatgggatgttggagctggcatcgctttattcgtcttaacgggacacgacaactgggtccgaggcgtagtatttcatccaggaggcaaatttttggtctctgctagcgatgacaaaacacttagggtatgggatctgagaaataaacgttgcatgaagacactggatgcacacaaacacttttgcacatctgtggatttccacaaggcgctcccctacgttatatcgggcagtgtagatcaatcagtgaaagtgtgggaatgtcgctaagatgtatgtcgctccattcctcaataaatttccaagcgggtcggaacaagaatgttctgaaattaaaaaaagacagtagttcagtgcgtgcaagtagaaaacttttttacttaagtcacaccacgttttacgtgcctggtttttacatcatatatgtcttacgatcagttatttccaggtacttgatgattatttcctcatcctaagttttcatttaaaaaattaaaacgtttatttaagagataacttatatatttttttttgttatttttaatcgatcgctctagaagtttcacgtcctagattttactgtgttagatgaattttttaacggattaattattattgtataactcttacgtttctatgtgatattccggtggaatttttagagcttaaattagcttatatttaaaggtagatgcttcttagggataactcgcaaacaaattcatgagtagctaatccagtcattttaggtacgcgcagaaatgtggtttttttcggcactgattacgacagccatcccattacacgtactacacacaccggagagcgaacgtcatatttctgccgaacagtatttttaaccaacattgttcaatacggcctgaaaccgatttttgtccaacaaaacaaaaaataggttatctactagtcataaaactgacagaaaaatgtgaaccactttttaaaacgtcagacttgttaattgataataaacattgatgtaaaagaataaaataagttgttataatatcgtacagtactttttttatttgtctgtcacatgtcacatgcaagtccatgtctctagaatcaattcattataaatggtgacaactctgcaccactgcaagttgagtctttagtgaataggtactctgttggaagctaggacaaataatccccggacaaaaaatccccacaaattatccctggacagaaaatccccggaccaaaaatcccggacaaataatcc

SEQ ID NO: 12 - DNA, 2204 bp, Diabrotica virgifera
  Annotation=Wd-repeat protein
  SmartBlast Evalue=0; Info=Wd-repeat protein n=2 Tax=Culicini RepID=Q16P29_AEDAE
gccggccacagatttgatactattccagttgtcaagtgttgtcaaaagatttatcctatctacttttccttataaggcaacataaccgctaagatacggtttagtgattcagttctaagataaaacttttacttttatataaaaaatacaccattgctgtacattagcgaagaaacaagttatttattctgtttatatagataagaaaatatttaaagaaatagaagaaatcgccgcccggaaaaatgtcctacacaccaaaaagtatttatgccgctctccctagaactcaaagagggcaaccacttgtattgggcggagatcctaaaggaaagaattttttatataccaatgggaactctgtcatcataagaaatatcgagaatccttcaatttctgatgtttatacagaacactcatgccaagttaatgttgccaagtattccccaagcggcttctacatagcttctggagatcagtctggtaagataagaatatgggacacggtgaacaaagaacatatcctcaaaaacgaatttcaccctatcgggggcccgatcaaagacatcgcatggtctccagacaaccagaggatgatagttgtaggggaaggccgtgaacgattcgggcatgtcttcatgtcagaaacaggtacgtcagtcggagaaatttctggtcagtccaaacccataaactcctgcgattttagaccagccaggcctttcagacttattaccggatcagaagacaacaccatcgctatattcgaaggaccaccgttcaaatttaagatgaccaaacaggaacactctcgcttcgttcaagctgtaagatactccccctcaggaaacttgtttgcttcagcaggtttcgacggtaaagttttcctctacgacggtacgtcgtccgacttggtaggcgaagtcggagcgccagctcattctggaggcgtctatggcgtagcttggagtcctgacggcaaacaactgttgactgcaagtggagacaagactgctaagttgtgggacgtagaaacgaggcaagtagtgtccgaatttgtcttaggaaacactgttgatgaccaacaagtatcatgtctttggcaaggcgactacctcctaacggtgtctctaaatggttttattaactacttagacgtcaatgatccaactaaacccctaagggttattaaaggtcacaacaaacctatcactgccctaaccctcagcgaagacagaacaacgatgtacactgcctctcatgatggatttgttaccaattggaatgtagaaagtggagagaacaatagggttaccggtgcaggtcacggtaatcaagttaatggtataaaagtcgcagaagaaactgtctatacatgcggaattgatgatagcttaaggcaaattgatgtagaaggaaacacgtacaaagctcaaagtctgaaactcggttctcaaccgagaggtatggatatacttaaatccgaaaacgttattataactgccagtgtaaatgaaattacggtagccaaagatacccaaaaacttagcactttaaaagtgaattacgaaccttccagcgttagttgttcctcgaatggtcacattgctattggaggaactgtagataataaagtacacgtgttcaaactcgaaaataataatttggaaccagttacagagttgacccatctcggtcctgtaatggacgttgcctattcaccggacgacaagtatttagtagcttgtgatggtcataggaaggtagtactgtatgagacagaagaatataagcttgccaataaccaggagtggggattccacaatgccagagtgaactgtgttgcctggtcaccagactcactattggtggctagtggtagtttagatacaagtattattatttggcacgtcgaaaaacctgccaaacatatcgttattaaatctgctcatgctcaaaatcaaattacaagacttgcctgggtagacaataccacgttagtgtccgttggacaagactgcaataccaaactgtggactattacccctttttagcgctttaatatttatatatctaacgcatttgttatgaactaatatcgtttgataaattatgtatactttcgctttctcatcaatgcatttatactaaaacttatttatgtaccatactgttgacatattataactttcaaaaaataaata

SEQ ID NO: 13 - DNA, 2143 bp, Diabrotica virgifera
  Annotation=Glutaminyl-trna synthetase
  SmartBlast Evalue=0; Info=Glutaminyl-trna synthetase n=1 Tax= Aedes aegypti RepID=Q16Q55_AEDAE
aagggagaatatagacgaacttctatttcttgaggatcactgacccaatggataaaagcctttggtttcgatttaacttgatctacttccgtacacttgcatataacttccttgatgccattgccgtcttttttaacatcagttacttccaaaactaaaccagcatgtcggataccaacggactgcgtttttgttagtcgacggtagcctttgtctccaacctccatgaagtcgcttttctcaatgtatatagttctattcagaataacatcgtgattacccagttctggcttggatgggaagtttggaactgacacagctatgggcttactatgcgggaagttttctattgtaattttcaatggttctaaaacaaccatcctcctcggcgctgtattatttaagtaatctctaacgaaggcctccaacatggacggatctacagtgctttgagaccctgtaactcccaattgagcacagaaattgttaacggcttctgaaggaaatccgcgtcttcttaaggcagtgagtgtgaacagtcttgggtcgtcccaatctttaactacttgttcatcaataagtttggctatttttctttttgatacgacggtatagttaacattgagccggccgtattcccactgtacagggcaataaatatttagggcattgcataaccagtagtaacttgaacgcctggattgaaactccttggtacaaagtgaatgcgtgatatgttctatactatcacataaacaatgggtgtaatcgtaagttgggtagatacaccatttgtctccagttctatgatggggagtgaatcttaccctataggccactggatccaattttccctcttccaaagtaattttcattctcaatgttgctgcgccttcgtcgatttttccatttttcatatcctcaaagagctgtaaattctcttcgactggcctatccctccatggcgaaggttgaggattgaaccctttcatctcatcagctgtttggtgacaaacgtatgcaagtcctttcttgattaactcaatcgcccatgtatacaattggtcgaaatagtccgaggagtgtgttatcttatatggggtatatcccaaccaagtaaccatatctttaatgcccgtgaaaaatttttcttcttctttttcaggattagtatcatcatatctaaggaaacatatgccattgttggcagcagcatatccgaaattgatgttaatagctttggcatgaccaatgtgcaagataccattgggttctggagggaatcttgttcttacctgaccgccagtaattttcagatgttctttcaataatctttcagtattttctgttacaacgtatccatccgttttgtagttttctccgggtgcatgaaagttgacttttttcataacatctaatattgttaaaccctgatccagttcttgttcaactttctgcacatctttagtttgcttgacttcatttttggtaactttactggcttttttatccggtttgggagcaggtgctaagtctgcttcagtcttgggtccaagcagatcaaaaacctgaagatccacctcactttttactgcctttccatctgcccacaccaagtcagctctaactttctgcatcagtggcccggtattgaatctgtatctcttctccagaagatcctttttgttgtcttttatgtacttctcaactactttttcgatttgttctggcgttattacaacaccgacaccacagaaggtctccaactcattcgtatttaattcttttatatgagaaagagcaaactcaatggctttgtccactctcaaagtagtatcaagtttgtttgaagcgatatatttaacaagaataggtaaatgatgggaaatctgcggcttaatttttgtgcccagctggtacagcaatgtcccaaccccatcggatatgtttactcctcgtacttcatgaagaattttgagaagagttgaggtaactgtggtattttttaaagtctcctttgccttttgttcacttaagcccaaactcattagggcttttattgtatcttcattattttgagtcatttttcaaaaatataacctacttactaacagatgcaattcgtaaccggattgccgatgac

SEQ ID NO: 14 - DNA, 2113 bp, Diabrotica virgifera
  Annotation=Transcription factor 25
  SmartBlast Evalue=1E-144; Info=Transcription factor 25 n=1 Tax= Camponotus floridanus RepID=E2ADA0_9HYME
cgtcaatcctgtaaacgtcaaaacaaaatgtagaagggtttgattaataaattgtaatttaacgataataaaattgttgaatcaagataaaatagttaacgctataatcatgtcgtcgagagtgttgcgaaaactacaaggcgataaagagaaagaactcgccgaagaaatttcggacacagaaactgacacaccagtaagtggtggagctagaagaaagcagctaaatattaatcgctatgatttgctaaatcaacaatctcattctgagagtgaagtcaaagaggacgacaatgaaacagaagcagcaaaatcttgtgaaggagagcatcacgagataaaaagaaaaagaaaaagaagaagaaaaagtctggaaaacataccaatactcaaagaagtagtgaagataatgctgatgtcgatgaggtagaaaaatccctgagagaagtaaataagattctaggggaaaactatgcttctaaggcttcaactgttccgaacgtaaaacatgaaaaagttaacttcaaaaagaacactttatctgttcagcataaacacttaaacccaaacaatgaactcaaaaggatatttggatcaaagattgttcagtgtgatcataaacgtaaaaaccgaggcagaggccacgtcaaacaaacaacgatggtcaattgcaaggaaaactacccaaacgccggaaaatccggtctttcgatgtcatatctagagaacaaaaacaacatccactatttcacgtacgagcacagccagagttacagacaagtacaaaataaattcttggacgccgtggagagtctcaatcccgacaacatagttgccatattgaacgaacatcagtaccatgtggatgccttgattcaactgtctgacgtctgcgaattaagcgaacatctggcaactgcggccgagcttatagagcgtgcattgtactgtttggaatatgcgtatcatcctctgttcaatgttgctcaaggaaactgtagactagattatagaaggcaagaaaatagggcactgtacatagtgatattcaaacatttgatgtttatcggaggaaaagcatgctacagaacttccttagagttttgtaagctgttattgtctctagatccagaaggagatcctctaggaatcgtattatccatagatttttatgccatacgcgctagagaataccagtggttgatcgatttcgtggaagagtgggatggggccaaaaatctgatgtggttgccaaatttcgcgtattccttgggagtggcgcatttttatctcggagacagcgcaaaggccgatttaatactgcaagaagctcttctaaaattccccggtgtactactacctttgctagataagtgcagcgtgcagactgacaatagagtctctagtcatcaattttttgtcactgctgatgacgccaaaaggcaacccacagcactgactcaaataatactcctatatgtaaatagaagctatcacatatggaaagacagcgatctgctgccttggttggaaaagaacgtgcacgaggcattggacagagtagagaaaaacgatgctgtgctgaaagagtacgaagcgaagagattgaagagttttcacggaaatctgccgttgagtatatctcgacacatcttactgtcaaacattaaaggaatatctcctatgactgatgaaaacagtggaactgtcacgagttttgatccactaccaccttcggactctattaatttatacactagaccaaaacgaccaacgctagcccagcatgcgggaggtaataccttgagtatattcttcagatcaattttgccaaatttcaatccaaacttacccgatcctgtgcgagacgatgaaggagctcgagcattacccgcaggcgagaacaacatggaactaggcgatttgagaagtagcgtagcttcattagtggatgccatgagggatttgctgagcaatattcggccggaagtgccaaacgatgccgacgcggaggaaaatgatgattccggagatgacgacgacttgacatgatttaaattccttttatttaagacgtttacgtaggataaaataatattaaatacaaagcttt

SEQ ID NO: 15 - DNA, 2084 bp, Diabrotica virgifera
  Annotation=Sphingosine-1-phosphate lyase
  SmartBlast Evalue=0; Info=Sphingosine-1-phosphate lyase n=1 Tax= Harpegnathos saltator RepID=E2BL08_9HYME
gttcattacttgtaacattttcattttcaagaattttataaatattgtaattccattttttaagtactgaacattatttgtccatgtttagaacgttcaaggttcaaatgcggatccaataacaagcgaaaattctcaagagatccattgtgccatgcaaaagttttatcttatctttgttcaagtatagatatattgtttcaaagttacattattttctcttttaactgcctggtgcctggctatatatgtcttatactagttggtcaagcgcgttaatcatttttacgtattacagatagaaatggattatctgtctgtaccaattaatgccttaaagggcactctaaataatcactttcaagggaaggaagcttggcaaatagtcacaagcactactacaactgtgctgttgtctgtatggttttatggatttttatttcaagatgagagtcttaccgaaagaacaaagaaaacagtatttaggttagcaagaagaattcctgcgatcagaaggaaaatagagactgaattggacacaatagcaaagagttttgaagatgacattaagaaatcaaccagtactgtaacatatattactgaactacctcaaaaagggctgacaaatgacgaacttattcaatgtttggaccagaatttgtctctgggtgaatacaactggaaaggtggtaaagtatcaggagctgtctatttttacaatcaagatttaataaacctcatttctggcatttatggtaaaactgcttacacaaatcctttacatccagatttatttcccggagtatgcaaaatggaagcagaagttattagaatagcatctaatctatttcatggagacgagaatgtagttggatcgatgacaagtggcggtaccgaatcaatactgatggcctgcaaggcatacagagactatgccagagaagttaaaggcattaaaaagccagaaatagtcgtaccaacaacagtgcattcagcgtttgataaggctgcacaatatttgaagttaaaagttagatctatcccagttgatccccaaacataccaagtaaatattacgaaatttagaagagctatcaattcgaatacgatcttgttagtagggtcagctccaaatttcccatacggaaccatggataatataacagccatatctgaattggggttgaagtatggcatacctgttcacgtcgactcttgtctaggaggatttttgagctgttttatggaagaggcgggatatcccatacctttgtgcgattttagactacctggagttaccagtatttctgctgatacacataaatatggctacacaccaaaaggttcttcggtggtaatgtacaggaacaaagaataccgtcactaccaatacacagtaacgacagattggcctggtggtgtctacggttcaccaagtgttagcggatcgagaccaggcggtaacatagcagtctgttgggctgccatgctcaattttggtaaagagcagtatgtacaagccacccgagatgttatacatacatctagatatatagaaaaaggattacgcaggatgaagggcattttcatttttggaacacctgttactagcgttgtagccatcggttcaaatgacttcgagatatacagattatctgcggcactcaaagaatgcggatggagtttgaacactctacaattcccttcaggaatccatttgtgtgtaactagacagcatactcaaccaggagtagcagataaattcttagaagacgtcagaacgtctttggatgaaattttgaaggatccatctctacctgtaactggaaagatggcgctttatggaactgctcaagagttaccagacagatccatcgttggtgatttcacgagattatttttggattctatgttatatgtacctttaccaaaaaaagacaaagtagagggaaacattaaagcttaaagtattttaatacagatatttttaaatgtgggtatatttgtatacatgttgaaattattttgttaaaggtttatattgccataatatttgtgatctatatttaataaatgtttatttg

SEQ ID NO: 16 - DNA, 2071 bp, Diabrotica virgifera
  Annotation=Cleft lip and palate transmembrane protein
  SmartBlast Evalue=0; Info=Cleft lip and palate transmembrane protein 1 n=1 Tax=Culex quinquefasciatus RepID=B0W5N9_CULQU
tcacatttattttaaatatttgcattagatacaattaatttaaacaacagttcttttaagcctaaaataagaagacaagtaggtacgcgctactttacacaaacaacctatttatctttctttgcttcactcacactttggtctgcattctcggtaatactcttttggttttcgtcttgttctgccttatagccgtactcatttacacgagtcttatctacaggataaatgtatctttgatatagatatatcaagaatataatatcgtctctgaaacaaccgatcctgtacatagttggcatcttaataacgaacgcaaacatatcatctataaaagtattcaaaaacttgtaagttaacattctccatggcaaatgggctacggatttcagtttataatttatgaacaattggggagtcatcattataaaaccaaacgttaacaagtatccatagagaagatctaacacgaaagagtaccaacctttatgttcgagataaataagtgcgtacccactgtagcacgcgaacaatgggaaacaaacccacgataggtatttaaatgctagcttatcatatacttttgtactagactgaacataagaactcttatctttaaacgttaatctaccattttcgaattttatatctactactttccatatcttccaaaattctatacccaaacctactaaacaagaaactcgtatcaacgtgtttgtttcgttgtctaaaacgtacaacaaaacaactagagattgaaatactccaaagaaaacggacctaacagacaaaccttccagagaatttctgttgttccaaaattgaatatcattcttaaaagcaagaagttcgaaaacagagtgaactattgataccgcgatagtgatacccaaaagataagggttagtatccatcaaggtttctttaagcgtatcttgttcttcgtcggactgtgtctgttcatcgccccagacattccaactctgtctcatgtgttgtgcggcgtacagctgccatttgaacaagctcagtggctggaatgtaatttgaagtgaataagtctcgtttaaaggtttataatcacgagccatgttccaaaagtcgtttgcaaataacactggtttatattgctttccatcatctgtgaatcgaataaactgatctagagggactggcactccaccgtaattccacaaagtttgatcagtcaccagattcaatgtaaagtttggatgccagtgggatattatttttccatcttcgactatttccttttcagtttcgccggtcaagagattttttgtaccacttgctttgagcttcttatatctatttaattgcttcatgactgatgacatttgattttttgcaaagttcttagcttcaggatcaggactgtatccggacctgactagatatgcatgtataaataaggaaccattattcttcatatgtgcagtgattgggacatctttttctattgtataagacccatctttatcttttcctgatgtccagtctccgtatttaagcccttctttgtaccagaacacattggaaggactataattatccattgtttcattttctgataaataaatatatagattcattattgtgccatctgggaatatgtttctggctgcggtttgtggcaattttactccttgatcatttgttggcttttggggttgtggacttctaaagaatgagaatataaaatacatgatcattgctcttattatgagagatttaactacagccagaaatgattccatttttgttggagctctttgttgggcagcatcattttgtgcaacaccaggttcttcattgcttgctgttatctcaccaggaggagccccattaacctctttctgagctgcactcattgtaattatattaaagtaaactttacgctaatatcatgtcacaatgataatatatgacggtttagacttttaaaagtataataacacgtgagtcagtaaaaaacttaatgaaattagttcagtagaatatttttaagaactttggattttttggggatttgtaatgacagtgacag

SEQ ID NO: 17 - DNA, 2010 bp, Diabrotica virgifera
  Annotation=Vesicle docking protein P115
  SmartBlast Evalue=0; Info=Vesicle docking protein P115 n=1 Tax= Aedes aegypti RepID=Q17BY2_AEDAE
tctcgctgaactccctaacgcctggataataactccttccagagattttaataacttacaaaattcgaactccaataaaagttcgctggaatgtttggccttaatctggggttgcttggctgccttggcgtacacttcgtgtctggatatttcgactagttttttgcagtatgtatctaatcctacacgtttctctactagctggcttaagttttccttcgagtaattttgtactgaattgtcgttatatagcacacagagacccatgaggaatgcacaaaggccctggaggagttcttcattattatcaaactcactagcagacgtttgggcagtcaggtaggccatagatccgggaacatttaaaaatatttttacagcttctgatgaatgtgacatccactgtgccagcagcattaacactcccagttttgcttgtaatttactcgtatgttgtaaatataccgcacattggtgaagtaaactaacaggttgagatcctaaactagtagctaataaaaccctgagtaactgttccttctgagctggattctcgatgaggcagtgagacatggccacagcagaaaaccaattactcaaatgatccttactaaacaagccactacacaatatttgtcccatactaagattagaagctgcggtgttgctgggcagcaacgtttgaaccactaattcttgtccgatctcatttttaaacaaaaaacattcgaagcaatatagcaccgcgcatcttagagtaaaaggctgcttctcgttgaccatggacattaatagaactactatggctgggcgaggagggttggagggtgctaatacgtttgtgaagtattcttgatttgttaaatttcctctgattacttctcctactgtgttgatagtttccgtaaggatatcagcaggtactccatttgccattaaaatgttgcataaagcttctaataaattagtgttccttaaagttttctgacaagctgtgataatttgtgaagaattattgggagatacaacagtgcgcaccaattgcagaacacaaagaaaattcgacactttctgaggagtccagccaatttcctccaaatttgggggcaattcaaacattggtgcaatcctttgtagataggaaccttcttggaagaagttgatattactattattatttcttaaaagattcagcattagtagtaacccatcttctactacaatacctccatcagtccaaccttcacctcttattatatcaaatagtctatcaaatgcattttcaaatgcaacgattttttgcatattagcgttagatttggttaaattaattaacagcaacaatgcatcatttctaataacttccctattctctaacaacaaatccatcaacttcgacacacccatggggctgactagtatgatatcttgcacatcttttggtttagatgctactaatgacgtcattaatcttacagctggccatctaaccctaaaatcgtattcttccataaatcctaatattaacgtcacattttcggaatttttaaggaacatctctgtgaattgttctcctacattaatttgtcgatttaggttttcattttcttcttcgaatgtttcttttgatgttatattgcataaggtatccaaacagtatcctactatttcgcagtcactcctgtccagttctaatacttgtctcaatatgtctagaccctgggccccaacttccagtctatttttcttggaaagggctttaatagctctacaggcatctcttctgtcttctaataatgtagatgtactaactcgactaaataacctttcaactatttctgcatctgtgggttgatttccgggcgctgttgtacctaagacggatttaagtccacttctaaaatactccatttttttggttcaagtctctacaagggtacagtcataactttatacattttattattcaattccaaatcaaacctaaaatcaacacatcacatattcata

SEQ ID NO: 18 - DNA, 1978 bp, Diabrotica virgifera
  Annotation=Glutaminase kidney isoform, mitochondrial
  SmartBlast Evalue=0; Info=Glutaminase kidney isoform, mitochondrial n=1 Tax=Harpegnathos saltator RepID=E2C8Y4_9HYME
ttaattctttattaatttggaaattatgctaattacactgacaaaaatcaacgttcttcatacataagttcaatacctgtcgtcctttcttaattgtctaaaatttgacttgaagtttgttggctatcaacctaaggaacttttggaagttcaacattattaaataccaagtaggttgtactcagtacctaaataagtctccatagaataaaatctaaaaattacgttccagatatgactctgcacaataaaagaataatgtttacgtacttttcatttaacagatataaattattgaacttttaactttattgacattagatacattgccttagtcttgagattttattgcctctgcacattcgaatacctataggtacgcatctctacactttctcattcttgcttataaaatcgggaatcaagggatcatcttcggctctggtattattatttgattttttgctaccttcttcaacccattgctgcaacatttctacaaccgttgtgtgaccaaaagcagttgcttcttctaagggtgttcttccccacctgtctctaacatcgtactgaacattgcaatacttaagaaggaattcgacacagtgcagatgtccttcagctgctgccaagtgaagagctgttcgaccatcgtagtcagacagtgtcatgtccatgcccgaaagtttgtgccttcgcaaactaggcagatctccagacgcagccgaaaaaagtaagttcactatatttagacctttagtttcaaatttgtgctttcttgggtctgatttatcggaagcatgtcttaagttatcatatctgtggaaattgaatttctttactagctcctcacaaaattgtacacccctgcaactgtttcctagtgcgtctaaaggtggagaatacaaacacatacccattacatttggaacaactaccaacatagctccgctcactccagatttagctggcaatccaaccttgaaagcaaactgtcccgaatagtcatacattccacaactatgcatcaacgacagaacgtctctcacactctcaggcttcagaactttttcttctgataaaggacaaataccgccattggctaaggtggcggccattacggctactaaatcacaattgacttctagggaacaacactgaaaatagaaatccatacattctctaaatttactactttctgggaaacatttatgttccctcatgtagaaacctagggcatagttacgatcagcacattcacgttctgacaagaatactgcattattaaacctaaatcttcccttccggccaacctctcaaagaagttcatagtaaagtcaaacttctctgctgagctcatttctggagaatacattgtcttcaacaacgagcaaataataatagccccagcattaatcataggattatgaggtttcttattgtggtcgaggatgagttcgttgaagtttctaccactaggttcttgaccaacatactgatgaacaacgtctgctccaagcaagtctaaagctataccgtaagacaaaggtttgctacatgactggattgtgaacggtatattaacatctcctattgaatatcgttgtccgtctatagttacaatactgactccccaataattcgggttcatgcgttttagctgtggaatgtacgacgccaccgttccgcttgtgttttctttgcacttccaataaattagttctaactctttactaaattcttgaaattcgggtataataaattgatgtctaaaggcgtatgacaatagtcccacatttggttgtactatgcttctaaattgttctagtgttagcttctgagtatcgacatcattcccatcagactttgttttcgacaacttttttaagtctccatcatatcctgcaaccgcagatctgtttttcgagacctgtagccttgactgccgacagaactttccaatgtgcagcaatccagt

SEQ ID NO: 19 - DNA, 1910 bp, Diabrotica virgifera
  Annotation=eukaryotic translation initiation factor 2A
  SmartBlast Evalue=1E-160; Info=eukaryotic translation initiation factor 2A n=1 Tax=Nasonia vitripennis RepID= UPI0001A46D46
aaaaagagctagaaacacattggacatccaaaaagtgtccaaaaacagaactctatcctcatactccattgaactacaatattcccacaaaaatgtataagaagacgtgattttaatttgtctctgacaaattatttttatttagattatacatttctataaaagtaacgtttttcaagtacatttgagacattaattttgttcaatcatggctatccccattgcagctcgtagttcatcaggaattactctctatgaaggattacctactcctggtaacaagccaacatgtccaccaattcagagtaaggcctgtcgtaccatgttgtttgatcaagacggaaaatacttggcatatgtgaatggacaaactttatgtgtgctacaaactgaaaattggcaaacattggccaccatagagaacgttaaagcctatcagttggcattttcaccaaaaggaacttttttaatgagctgggagcctttcacagtcagtaacgccaaccctcagggtactccaaacttaaagatatataaaactgccaatggggaacttgtcaagaccttcgtacacaaaaaacaagctaattgggaacctcaatggagtcatgacgaaaaacttttttcgaggatagtaaacactgacgttgtgttttacgaagatctaaattttgagagaatagtcgctagaattaacagttcaaaggtctcgtcttataagatttcacctaacgttggtgtctattttgttctttgtcacacactgggcagtccgggacaaccttctcttgctagattatttaaatacccttcttttgataccacgcaagcgattgccaatagaagttttttccaagctgataaagttgatattatgtggaatgccaaaggtaacagtgcattgttgttaacatctacagaagtcgacaagacaggaggatcgtattatggaaaacaagggttatatttcgtgggtttaaatggagagacttcgataataaccttaagtaaagaaggtcccatttacagcgttgaatggtctccaaaaaacaacgagttctgcgtcatatacggtttcatgccagctaaagctaccatcttcaacataaaatgtgagcctgtcttcgagctgggatctggccccaaaaacgctatccattacaaccctcaaggaaatattcttctcttaggaggttttggcaatctaaggggtcaagtcgagctatgggatactgcaaattggaagaaaataagtagttgtgaagcaccagataccacgctgcttcattgggccgctgatggggagcactttttgactgccaccacggctccgaggctgcggatcagcaatgggtataaaatctggcattatacgggagttttgatctttgaacaccctcataaggaacctgaagaattgtatgatgtagcttggaagaacgtccccaaaggagtgttccgtgatccagttatttcagccaaaaaagttgaaggaatagctccaagtcagccgcaagcttcagcgcaagtttatagacctccttctgctagaaatcgtcctacggttaactttaacctgcacgaagatgaagaaactgcacataaaccgggcaaagattctgctccatctaaggcttccctgaagcagaagaagaaaagggaagcaaagaaggctaaaaagttggaggaagtgaacgaagacgaacccaaaacgccagcggctgtcagtagtgttaaaataaatttaactggtgatccagaattggataaaaagctcaaaaatatcaaaaagaaactggacgccatagaaaagctcaaaacacagcaagctgagggcaaaactctagaaatcaatcaactcgaaaaaataaaagcagaaaacgatctgctggcagaactcaagaatctaa

SEQ ID NO: 20 - DNA, 1842 bp, Diabrotica virgifera
  Annotation=T-complex protein 1 subunit delta
  SmartBlast Evalue=0; Info=T-complex protein 1 subunit delta n=4 Tax=Culicidae RepID=TCPD_AEDTR
ttaaacgtttagtaatctaataaaatgaagattttaaataccgttatgaaaatacgtaatacatgaaacgaattaaagctgagatgtgttcgaaagttaaaataggtcactaagaggtggcagatcttatgtgaatgtgttaacaatatcatcgattttcaagatcgatctcacagtttctgtagctaaactcaatgctgaagtgctaactaaaagtggttgaacaacattttcttcgagaatatctgtaatagctcctttacgaacgtttattccagcagatgtctctcctttggcgtgtctgtttcttagttcagtaacggtctgtatgggatttaatcctgcattctcagacaaggtaaatggtataatctctaaggcattcgcatatgcccgtgtgcaaatggcatcaatgccttccagtttgttggccatagccgctagtttaagagccacctcaacctcgggcgctcctcctccggcaataagtgccttcttgcgaacaagacaacgaattacacatagagcatcatgaagagatctatcagcctcttcaagaactaatttgttggatcctctaaccagcagagttactgtcctgcctgcattttgtgcacctgtaattttgaccattctatttcctgccaatccaacctcttcaactaaatcagcagtaaccaagttttcagcaacaaaatgatccaaagatgcaatagggcggcatcctaaagatttacatacaaattcgacatcttctctttcaatatccttaataaccatacacttgattttatccaaaaagtgtaaggcaagatctgaaactgcatccctcaaaattgatttttgaaccaaaagtacattacatccagctttctttatctgcttgacaatattcaaaatatatgctctctcttcttttaatactctatccatagcagcgtaatcagaaacaatgacattgtggtccatatctgtttttggaggtgaaatacagaactggatgaaaccaattttagctttctcaatcctttttggtccagagacatttgcagatctttgagggaaacaaattccttctactaattcggtatcttctactgtacctccaagttgcttaataactttgatatcagataaattacaagcttgttctctaccaggttcaacaattttaagaactgcatcgacagcaagtggacccaaaaagcttgagtgttgggaaacaacttttgagtttagggaagtggatgcacttttaattaacaattctctattagtaatttcaattggagtagaaatgtctgacaaaatatcaactgccaactgggctgctctttggaaagattcagatattgctgtagggtgaattcccctttgtaataacttttccgcagcatccaacaaagctcctgcaattacaacaacagatgtggtaccgtctcctgcttcaatgtcttgggcccttgataattctaccaacattttagcagcagggtgaatgaggtttatttgtttcaagattgtagctccatcattggtaattgtcacttcaccatttccagcctggatcattttatccattcctctagggccaagacttgtacggatagcatcgcaaacagcttttgcggcgttaatattactggtcctgacatcagcgggtttacttttgtccttatatgcaacggttcttcctctatttgtatcaccaccggctgtaggcgcagtcatatttgattttattattgttttttatttaaaaaagatattcctgaagccgatgtttacagattatattcttgaaaatttcactccctaaaattggattattttggtgctgtc

SEQ ID NO: 21 - DNA, 1825 bp, Diabrotica virgifera
  Annotation=ATP-grasp enzyme-like protein
  SmartBlast Evalue=1E-31; Info=ATP-grasp enzyme-like protein n=1 Tax=Anabaena variabilis ATCC 29413 RepID=Q3M6C5_ANAVT
ctctctcccattgagaaaaacaaaaacactaccgtacagccgtagtcatcggcctgggaaaactgtcttgtctccttctaacaaaaccaagaacatttttaaatggaatttgcatgtggtagtacgcgcagtagggtaaaggatcccacattgcgaacaaagcctctcttctatccaaaactgtgcctatgagcctcgttactgattccagggaaggattgctgactgtgtgcatcaccgtttgtggcatgttatacacgccattaccattgattaaaggaccagaattttgacgactaaaatgtctgcatggcttccacaccaaccttggatgcaccgaagtgtaacaaatataaggcaaagatactcctaccctgctactcaaaggaatcactgtaccagattctttgcaaagtacaaacctgaagctgatgtgtccagagatcggccttaacaagttgattttattgaaaaaattcgtcagccattggttaatttctctgttttcttccgggaccagttcattagtattcttgttcatcttgcatgtaacatttgcgattacatgggattctttcaccgtagtgcaagtcaaataatggtcaccttctagattctgtactactacccaaggtttttgctcgctgatatcgttaggtattttcaaatcgtttctggacaaaggtagaagaatttttgaacgctcacgtaaacctcttggccctgcagtggacattacaaacattccccttcttatagcgccggtatcgtacaattttaaaacatcatctcgtgaggtcactacatgatatattggtgttgtaatctggttcttttgacaccgttttaatacttccaaagtgtcatcaagaacccaaacttctctgatacctggacaaaagcaagaacaacccaaaagttctaaatgaggtttagccacagcatcgtagtaagcaggagttgtagcagcaaccgggatgaaatacactgcttgctctttgtcaactatctcacaaagggctctaacatagttctgttgcttatcgctagtaggtttaggaactgtatagaacttactgactgctgtggaatatttggctaaagcgaaatgtccttctacttcacaaacgaccactcgtgctcctgctgaatagaaattcctggccagatgaagagcttgaatcgtacttcctccagttatgagcactgtcctcttcttgctgtttttggaagtgttcggagacaatatgaaagatagaatagccttaattatggtcaaaggcagctgcattaactgcgtgaaacaccacacccacatagaaatccatagcataggtagcgcaaatataagctgtctccatgtttgcggaagcactgcgatgaagagagctttcatcagtcgcagcaagaagcaaggataccaaccaataagttttgagagtaatgagtagacaaactcatcttcttcttcttcgtgacaacttaaagccgggctctgacttcttgagtctcgtacgtcagagcgaatgacgaaaggttcttgaataacacttcctagactggaagctcgtctgaacctttttctcagtgtggcatctggagaggaagaaattggcgagaaagacgtcggcgaagaagggctttggaatccagaaccactggagcagcttcctgcgtaaccactggacgaactaccggcatggatactttcattgctcggccatgacactttagacaaactttctgatggcacgaaaggcattgtgcccgaataaacaacaaactgattaacgccgtcaatacacgcacttaatagcaagtaaac

SEQ ID NO: 22 - DNA, 1805 bp, Diabrotica virgifera
  Annotation=Fimbrin
  SmartBlast Evalue=0; Info=Fimbrin n=1 Tax=Tribolium castaneum RepID=D6W8E0_TRICA
aatagcatcgataaggtcatacactttcccatcagaaatggaagaatctagaaaattacgaatggaagacttctttccagcaccgcttagtttattgttaacccaatttacaatttctttttctacgatgggactaccagaatctgctaactgggagagaattgacaatgtgtaagctctcatcaattgccatattaaagctagagtcaatgtaatgttgccctcattaatatcttgtcctccaataccgacaagagagaatttaatctctttgccaagttcgacggcatagttgcagttttctaacttctccatgaatttctttctctcgttagtgaacttgcgatgtactctgttccatttaacggttccaggtttaattatatcgtacaattggaagactattaatccatcagcaagatctgaatatagccagttgacgtgaggtgatactcccatagagtttatccagtttctgtaagttctttcctctctcgtttcttcaatggtctcgaatccgtcggttccattttgatgtaaagctggatggttattgaacaaattagctacgaaggctaaatttaatttgtaaactccgttgacaacatcctgaggagtgacgaaagctctgcactttagtttagcagcctgttgtaacataatctcggctctgctgattaaatccttttcatagagagcttcagtggtaacatcaatatctgcaggagcaatctgtttaagaaggtgagtgtaaacttcggaatctacaatatcgctctggaaattggtaacacgacgatgtgttccagctctttctaaatggtaattcacccatcgcaacaagatagcttctggagataatttcatcaaatcatcaatcttttcatcatcagagagcaacgtcgtcaatcctgggcaatgctctaatgtgatctggttgaaaagacctattctgattatttgccaaagaaggcctaatactaagtgaggtgttccttttgacaagttatgtgcgtctatgttaataacgttacaaccaattgcagaggcagatgataaggcgagtgtgaggttttctagttttgtgtacaatgtcaatttttctttgtttattgctctttcgtcaattgtatctggacatgaatggtttattactttgcacagcaaaataccatccttaactttctcgtagaggtttctaccttctgagtcgatcggcaagagtttctttaagtcaggatcatgctgtaaatttgaattgatccagtcagaaaacgctaattgttcttcaactctgactgaatgtgttgtaccttcgttcgacgcttcagaagtccctccaagatgctgcaggttttctctttttgatacagcagttcggaatgtgttagctacatcattagccttgagatcacagataagtttttcgaattcatcaaatgtcaatttaccatttatttttgatttattggaatttttgaactcctcttcaataaggcgtgattggtaaccagctatcttcagaccacataattctaaagcttctcttaattcctttaagtctatgtgcccatctccatttttatcaatctcacagaacctttctttgatttcttctcgttcttcttgtgttattccgtttgaagccatagcatataaaatgagtttaaaaacaaaaaatgcgtataatcacaaaaatttaattattgttcttttacactttgcgcaaaaggcaccattaactcaagccgccgcttctctcagacccgtcacaaaactatgtcggcaatacacgaatacacaac

SEQ ID NO: 23 - DNA, 1784 bp, Diabrotica virgifera
  misc_feature (1519)..(1519): n is a, c, g, or t
  Annotation=Pyridoxal-dependent decarboxylase domain-containing protein 1
  SmartBlast Evalue=1E-135; Info=Pyridoxal-dependent decarboxylase domain-containing protein 1 n=1 Tax=Camponotus floridanus RepID=E2AXN4_9HYME
aagctgcatccgtagatcgaagagtatcaaccagaaccatgttaagatggttaagttcttctttagcttgatcagtcaatatttgctcccatccctctggacaataccgtactccccctagacctgcccaatctggtagatcaacaatttttagcaccggagaaacttccaccaactttacgaagctctccctatggtggacagttgccttcaaaataaccagctgttgctctaaacacactataaaagcttgcatttcttctagatttggctgctggccacaaacgttttcgaatggacagaaccgaaggaccactccgatattttctaattcgcaaatgtcgattggcacttggggagcgtctatttgcaagatttgtccaagccaagagttgagtttgtcgtagtagggaggtacctttgcagtgtattcgctattatcggatgtttcgggaacaaattggaaaactactgaacaagctgtcgattccatcaaaagaggtatactggatggctttgaaaccagttcagctacggtgtaagtaccactctctcctcctggtttaggactcaacattctaacttgtctaaaaacgtccaatgcggaccacagcctttcactagccaggaaatcttctttgatcctggaatgcacaccttccgttcccaatttctgcaatcccgtccatagaggtaatgacaatatccttctactttggtgatcagtattcagtcctgctaaaactggtagcgtactctctctacttactcctacttgtttattgcgattagggttggtagtgccccataacctataaagggtaatcataggcagtcctggaattcccaaccaacttcctaaagttaaagtcaagctgtcagctattggaggaaccgttccattacgctgattataattcggcaaagccaaagcagctacactgtgtcctcggacatgtagccaagtcccatgcactttacaaagctccctaatcctagaaatattatctatatggcccgttacaggcgtgcccgcgtctgcaataactatgagaggcattcgaccggtagctacatcgtcggcaagcattttttgtagcgccgaaacgtccatagtgtactgggaaccaaagtatgtattgaccggtacaggcctaacgcatgctaacggtagtcctaactgtctgcaaagatgctgtacagtaccaagtggactggctacgctactataaacagtcggcagtgaattattcaatgttaaagctccgtcctctagatatcgggatatttgcagtgcagcatcatgcgggtaactcgtactaatccctctaaatgatcttcatggtaaaaagccgaacaatctaaaaacccaaataactgagttatccatctagtagtatcagtagtaaatcttgtgcttaacttctgcaaaataggcctttctagacctccacaatagactgccaaactgtgcgttaccattaccaacttagtaacactatccaaagaaggaaagttnaggggttcaccctcatcatctgtactaatcaacccatggatagtttttataatttcgtcagtatgtttcttttctaatcctaagaatacagtagaatgattatggacattttctggtattggaactccttcggcggcttgttctaacctactcactatttctgaagcttcaattgccaactcccctaagctatttttattatccgtagtcatttttttaatttacattgctgtatatcggttttctttaaataatcagatatttg

SEQ ID NO: 24 - DNA, 1781 bp, Diabrotica virgifera
  Annotation=Coatomer subunit delta (Fragment)
  SmartBlast Evalue=0; Info=Coatomer subunit delta (Fragment) n=1 Tax=Harpegnathos saltator RepID=E2BY86_9HYME
gaatggagagtacacgtcaacgtcatctcagtttggtttattgttgggtgtaatgtttaaataaaataattattattttgtaaacctgtgccattaaacaaataaagcgatggtgctaattgcagcagcagtctgcacgaaagcaggcaaaacaattgtgtctcgacaatttgttgaaatgaccaaagctagaatagaaggtttgttggctgcctttcctaaattaattcctacaggaacccagcatacatttgtggaaacagattcagtacggtatgtttatcaacccctagagaaactgtatatggttcttattacaactagagctagcaacatattagaagatcttgaaaccctccgtctattcgcaagagtgattcctgagtactgcaaatctttggatgaaaatgaaattgcagagaatgcattttcacttatatttgcttttgatgaaatagtggcattaggttatagggaaagtgtcaatctgtctcaaattcgcacatttgtggaaatggactcgcacgaagaaaaagtttatcaggccgtgagacagactcaagagcgcgaggccaagaatatgatgagagaaaaggcaaaagaacttcagagacagaagatcgaagcggccaaaaaaggagggaagacctcgtttggtagtagcggtggctttggcagctcgacaggttatactcctacgccatctgttggtgatgtagctaaccagacaaatgatgttaaaacttcttcatacacaccagcccctgcgcaaaaacctcggggtatgaaattaggtggaaaaggtagagatgtagaatcattcgtagatcagcttaaatcggaaggagaaaacgtcattactccaaacaaaaatagtatttcacagccaggaactaaagctccagctatcaaaactgacatcgatgatgttcatttaagattggaagaaaaattaatagtgagaataggtcgtgatggtggcgtacaacaattcgaattattgggacttgctactttacacattggagatgagagatggggtaggatacgtgtgcaattggaaaatcagaatacccacggtgttcaacttcaaacgcatcctaatgtagataaagaattattcaagctacgctcacagattggattgaaacaaccggctaaaccttttcctctaaatacagatgttggtgtactgaaatggagattacaaagtactgaggaagctctaattccactcttaataaattgctggccttcagaagcgggagatggtagttgcgatgttaatatagaatatgagcttgcccacactaatttggaactagttgatgtcaatattgttattcccttgccaattggatgttcaccaatagttggtgaatgtgatggtatgtacacacacgaagccaagcgtaatcaactggtatggaatttgcctctgattgatgccagtaataaaactggttctttagaatttaacgctcctagggccatacccgctgatttcttcccgctttccgttggattcaattcgaagtcatcctatgcgagtattaagattaccgaagttgtcctagttgatgatgattctcctataaaatattcagtggagaccgcactatatccagataaatatgaagtagtataatggggcagaagtaaagaatcacttgtaaaaattatataactaatattatatcttatatgcaacattgctttttgtacaaaagttaagtaacttgtctttattttatctatattaataaaataagtaagaaagt

SEQ ID NO: 25 - DNA, 1767 bp, Diabrotica virgifera
  Annotation=Putative phosphoglycerate kinase
  SmartBlast Evalue=1E-174; Info=Putative phosphoglycerate kinase n=2 Tax=Aphidinae RepID=Q5XUA9_TOXCI
ttaatttcaacgatcgtcaatccagttttagtttatatgttttagtttcagtatgttttctacacaataacaaagtacacataaaacaatcaatttttttgataaaaaacaaaaaatttgtgttttaaaaaatttgaaagtcgcaccaaaatcatttacagttatcttttttatcggcatcatctcgcgcaactgacctccacatgacattgacaatttttaagaatattttgaatccagcggcggtgagaggttcattttcatcagtaaaaatggcactaaacaaactcgcaatcgatgcaattgatctcgcaaacaaaagagttctgatgagagtggacttcaatgtccccttaaaagatggtgccataactaacaaccaaagaatcgtagcagctttagataccatcaagtatgccctggataaacaagcgaaaagtgtagttcttatgtctcacttgggaagaccagatggcagtcccaatccaaaatacaccttaaagcctgttgctggagaactggaaaaattactgagcaggccaatccagttcttacctgattgtgttggttccgaagttgaaaaggagtgtgctgatcccaagcctggttctgttattttgttagaaaacttgagataccacattgaagaagaagggaagggtgtagatgccagtggtaacaaagttaaagcagatcctgccaaagtcaaagcttttagagaaagtcttcgtaaattgggagatgtatacgttaatgatgcattcggtactgcacacagagcccattcgtcaatgatgggagaaggatttgacaagagagcttcaggatttttgcttaaaaaggaactgcagtatttcgctaaggctttggataaccccgaaaggcccttcttggcaattttggggggtgctaaagtagcagataaaatccagctgattgaaaatctgttagacaaagtaaacgagatgattattggtggtggtatggcatacacattccttaaagagagccaaggcatgaagattggagattccttgtatgacaaagaaggagcaaaaatcgtgaacaaactgttggaaaaagctaaagccaacaacgttcagatacatttacccgtagattttgttgttgctgatggattttctgaaaatgccaagactgattccgctaccgctgcagcgggtatttctgatggatggatgggactcgacattggaccaaaaactatcgaacaattcagagaacctgtcaggcgtgccaaagttatcgtttggaacggacctgctggtgtattcgagtgggataaatttgctacaggaactaaagccattatggatgaagttgtgaatgtcactggcaaaggagccatcactattattggtggaggcgatacagcaacctgcgcagccaaatggaagaccgaagacaaagtatctcacgtttcaaccggaggtggtgccagtctcgaactgttggagggaaaagttcttccaggagtcgccgcgttatctgatgcctaagaaccatcgttttcttcagacgtttctagaagaactcagaccaaacgttactcatacatattccaaagtctgcataaatctgtgttcaacatgggaagacgcgttatcaaatttgtggtctgaggataaattcctgcaaaattttgagtgtctgttactgtatgttcatataatgttccacaatttatttatgtagatatatttcatttgtttttgtcctcgttagacaataaaaatatttatcgat

SEQ ID NO: 26 - DNA, 1692 bp, Diabrotica virgifera
  Annotation=Glycylpeptide N-tetradecanoyltransferase 2
  SmartBlast Evalue=0; Info=Glycylpeptide N- tetradecanoyltransferase 2 n=1 Tax=Harpegnathos saltator RepID= E2C0S6_9HYME
attttaatgtttaatgggttaatgtctacttttgctgtcaatttagcccaaaatgtctgaagaaagtgaaaaaaactcgttggaaaaagttagtgaagtcgatggaagtacggacggaataatattaaataaaagtgcaaagaaacgtaacaaaaataaaaagaaaaagaatgaaaaccaagaagaaaacagtgaccaaagcaacgaggttgtccaagccgaaaacaacttattatctaacttatcgaaccctattaatacaatatcaattaaggagctaaaagcagccatggaggtatttactctatcacaaaaacctgccaagagttcagaggaagctctaaagaagacattccagttttggaatacccagcctgttcccaaaatggacgaaaaaataactgttaacgaagccattgaaccagacaaagaacctgctgacattagacaagaaccgtacagtttgcctgatggttttatgtgggacactcttaatctagatgaaccgttggtgctcaaagagttatatacgttactcaatgaaaactatgttgaagatgacgattgtatgtttagatttgattatcaacctgaatttttgaaatgggctttgcaacccccagggtggaagcgagaatggcattgtggagtcagagttgtaaaaagtggtagattagtgggatttatctctgcaattccagcaactctaaacatttataaaaagacacaaagaatggtggagataaattttctatgtgtacataaaaagctacgttccaaacgagtcgcaccagtgttgattcgagaaatcacccgcagagtacacctgaacggcctctttcaagcagtgtacaccgccggcatagtcctaccgaaaccagtgagtacttgtacctactggcatcgatcgctgaatccgaaaaaattaatcgaggtgaagttttctcatttgtctcgtaatatgacgctgcaacggactctcaagttgtacaaactgccggacaagcccaagactccgggatttaggaaaatgacagccgaagatatacctcaagctcacaaattactagtagagtatttaagtcgattcgacctagcgccatattttaacgaagaagagttcacacattggttcctacctagaacgaacataatcgacagtttcgtggtggaaaacaacggcgaaatcaccgatttcgtcagttactacactctgccatccacggtaatgcatcacccggtccacaagaacctgaaggccgcgtactctttctacaacgtatccaaaggcacgtcctgggtgcccctgatgacagatgccttaatctcagccaaacagctcagtttcgacgtgtacaatgccttagacctgatggaaaactccgagtttttgttgcaattgaagttcggactaggtgacgggaagttgcagtactatttatacaactggaagtgccctagtatgatgccgtgcaacataggactggttcttcaatagggcttagaaattattaatcgactttgcgttttttttttgtatgagatcggaacgtagaggcggaataacaatttctttatattgtcatggatttcaaattatataatatatacttttttgtctacaaatctttggtttcaattcaattatacttgtgatagttgatgtatcacttttaaatgtttatttagaac

SEQ ID NO: 27 - DNA, 1694 bp, Diabrotica virgifera
  Annotation=Succinyl-CoA:3-ketoacid-coenzyme A transferase 1, putative
  SmartBlast Evalue=1E-168; Info=Succinyl-CoA:3-ketoacid-coenzyme A transferase 1, putative n=1 Tax=Pediculus humanus corporis RepID=E0VMB0_PEDHC
gtaattttgaaaatgtgtttttaactagctttatcaaatatcaaataatcgagctatatctgtattgtttaaattcggcgatcgcatcttgagttcttatttttgtttagttaggtagcattttagttttaaattcaaaatgttcaagtctccagttttaggaaaagcaataggtttaaaaatttataaaggatctttaacatcacaaaatttaacaaaggttactatatgttgtttttcaacaaaaagtcccaaccggagaaaaatattttctatagacgaagcagttaaagatataaaaagtggatcaaaattattagttggtggttttggactttgtggtattcctgagaatctcattgctgccttactacaacatgaagccaaagatttaacagttgtgtcaaataatgctggggttgataaatttggattaggactcttgttaaaacagaaaaaagtcaaaaggatgatatcctcatatgtgggagaaaatgctgaattcgaaagacagtttttaagaggtgaattggaagtagaattgactccacagggcactttagcagaaaggataagggcaggtggcgcaggtattccagcattttttactccaacagcatatggaactcttgtacatgaaggtggggcccccattaaatatggtaaggaaggcaaaattgaaatagctagcaaaccaagagaatctcaaacatttggtggtaggtcttacattcttgaagaagccatcactggagactttgcactgattaaagcatggaaggcagatcctgcgggcaatctcttattcaggaaaactgctaggaattttaaccctacaatggcacaagcagctaaaacaacaatagtagaagttgaagaaatagttgaattgggtgaaattaaacctgacgatgtccatctacctggtatatttgtcgatagaattattttaggtgaaaaatacgaaaaaagaatagaaaaagttactgtgcgtaaaacgcaaagcagcacagagtctgtcataaagaagaatcccgccgccatcaatagggaaagaatagccaggagggctgctctcgaattcaaaaatggaatgtatgttaatctaggaattggtatgccaatgttgacctctaattatatcccagaaaacatggaagtatatttgcaatcagaaaatggagtcctaggtctcggtcctttcccagattcatgtgatgtggatccagatctcataaatgctggaaaagaaactattaccgtaatacctggttcttcattctttagcagtgatatgagttttactatgattagagggggtcatattgacttaactattttaggcgctatggaagtttcacaatatggagacctagcaaattggatgattcctggaaaattggtgaaaggtatgggcggtgccatggatctggtctcagctcctacgacgaaagtggtagtatgtatggaacactcagcgaaagacggcggtcacaaaatattagaaaattgtactcttcccataaccggcaaaaatgtagtggatatgataatcacagaaaaagcagtatttacaatagatccggaagctggactcaagcttattgaagttgctgagggtgtaggtgtagaggatattctcgcctcgactggctgcacctttgaagtagcagaagaattaaaaccaatgggac

SEQ ID NO: 28 - DNA, 1668 bp, Diabrotica virgifera
  Annotation=Sly1 protein-like protein
  SmartBlast Evalue=0; Info=Sly1 protein-like protein n=3 Tax= Aculeata RepID=E2BZI7_9HYME
gattatgtctcttaattactaaatttttaactccttccattacaaagtttgaaccttgtgataccaacttggaaaacatattaacagttttggttccggcaccttcatattgattccctatcccacttgccattttagtatagctcttccatcttttgatatacagcagtggtgataaatcacagccagcctcggttaatgcgttttcatatttgtgtaaatcgtgatccgagatatgaggggtacaaataaaatatattataaatagccgcaatttatcttcaggtgtccccgctgtaggatctgctaatatatccattagcagtttttccaagccttgtgctttgctcattattttctcctctaattcaaagaacgtgtctaattttctagatttaatgcagttaagcaaagatgtagctacagaagtatgcatgtcaatcaggcgtttctttctaataatgtggcaaggaattgacagccgacgttatcttagctgtattatcagacaccatcgtcaaagcgatatcattttcgttatcgattcccattgaactttttagtttcttcacttccccctctgacgatttgtactgttctaactcctcctgaattgcctcggccacggtgggaaaaggagaacctttgtgtgtagaccaaaatttatctttagaatccaactcacaagatcgactcttggctcttgctcctccagttggcaccgactcttcaatagtaacgcggtttagagccaaatctaacagatcatgagcaagtgcctgataagtccatgtgtgatgtagcgatgttgccatatctacgtttctatctaaaataatcaatagaggcctctggaaattaaaattgccggactgtgcgtccgaaacaaacaaattgtttctagtatcaaaaatattttctcgaagcttcttgtccagctttttggctaccatttcggctgcgtttcctttaggacttcgaattattggcacagttcctaaagttacaaagactgaaaacaagctgtccactatgttgttcataatagcctccatttctgaatcttttatatcacctttgtttatactgtaatatgacataatatcactgttttggtgttttaggacaaataaatcatcttccaatgaaatgaagtttatgtattgatcataaaccttatgaatatttgctacgctgtttgcagctattgctgctgaagctagatcctctaatttatctctagatatcggagaaataaaatttaagtggtatatgtcatatgttcctctttggaaatcttgacttatcctatctaaattatcttctgtggcagcacaaaaatatattgcaggaacctctggtattggatctctatccgaatgtaactgaacaaacaatgtaacgccttgttctctcaattctttcacagaaattaagggcgatataatgtcttgccctattctgtcgtaaattaatactttccatacaggttcagaggctgataacttagtctggggttgatttaaatttaacatttgctttatagcattgatttgtttctgtcttaaagacgtcatagttgaattaaagtttctggaaaaagttaaaacaaattaattatatgtttaatatttaatattaaaatacgtggacttagaaacccattcg

SEQ ID NO: 29 - DNA, 1587 bp, Diabrotica virgifera
  Annotation=Trifunctional enzyme beta subunit (Tp-beta)
  SmartBlast Evalue=1E-178; Info=Trifunctional enzyme beta subunit (Tp-beta) n=2 Tax=Culicini RepID=Q17IM1_AEDAE
cgaggggtcaaagtctaatctaaaaaatttaggttcaattttgtggactccgtttatattattaatttattttgttctttcatttaagtaaaagtaaaacaaaaaataaaatacgaaaatggctttaagttcagcgagaaatattgtaaaaaatcaggttacattaggcctaataaagcaacaaggcaatgctttgagaactttttcccttggaattcataacaatcagaagaaatctttggctcctaaaaatggtcagaacatagtattagtagatggagtaaggaccccctttttgttatctggaactgattatgcaaaacttatgccacatgaactggctaaacaggctctaagtggcattcttaagaagactggtgttccaaaggaaattatcgattatgttatttatggtactgtgatgcaagaagtcagaacttctaatattgctagggaagctgccctggttgctggatatagtgacaaaactcctgctcatactgtcacaatggcttgcatttcttcaaatgttgccatgacaacagctattggtcttattaacagtggcatttacgagacaatagtatgtggtggagtagaatttatgtcagatatccctattagacatagcagaaaaatgagaaacctactactaaaagcaaataaagcgaagaacctccaacagagactgtctttgttggcttcgatcagacctgattactttgtaccagatctcccatcaattgccgaattttcttctggagagactatgggccattcagccgacaggctcgctgctgcctttggagcaaaccgcaaggagcaagacgaatttgccttaaggtcacataccagagcacaagaagctgctgataaaggttacttaaccgacatcgtgccattccaagtaccaggagttgcaaagcaagtcgaaaaagataatggtatccgtgtatcaagtcctgaaaaattggcgtcactcaaaccagcttttattaaacctcatggaacggtcactgcagcaaatgcttcatttttgactgatggtgcttctgcttgcctcatcactacagaagctaagtgcaaacaactggggctaaaaccaaaagcgtacctcagaaacttcctttacgtatcccaagatcctatcgatcaacttcttctgggacctgcatacggaacacctcaagtattagaaagggctggactcacacccaaggagatcgatgtttgggaattccatgaagcctttgcaggtcaaattttggcgaacttaaaagcgcttgacagtgactggttcgctcagaaatacatgaatagacagaatagagttggagctcccgatctcaacaagttcaatgcctggggaggatcactttcaatcggacatccatttgctgctacaggtgtaagattggctatgcacacagctaatagattagttagagaagatggtcaatttggattggttgctgcatgtgctgctggtggtcaaggagtagccatgattttggagagacatcctgatgctacccccaattagtatggaaactgcaatgacaaactttactaagaaattatattaag

SEQ ID NO: 30 - DNA, 1565 bp, Diabrotica virgifera
  Annotation=Zgc:100980
  SmartBlast Evalue=1E-170; Info=Zgc:100980 n=2 Tax=Danio rerio RepID=Q6DGD7_DANRE
cttcttacctgctttagtgaaactatgtatcatccccctgctgatataactgagaatcctaacaagtggatcctatatttaacgtccgctgaaaacagacacgcacttccaatgttcacgtctttgttaaatacagtatgtgcttatgaccctgtaggtttaggtgtaccatataaccatctaatatttaacgattcccttgaaccactggttgaagctgctcttcagattcttattgttaccctagatcatgataccagctcttcaacaccagcagaaagtgaagatgtttcagttcccgataatctattcatcaattatctttctcgtatacacagagacgaagattttaattttatcttgactggtataacacgcttactaaataatccactagttcaaacttatctaccaaattccaccaaaaaagtgcattttcaccaagaattgttagttttcttctggaagttatgtgattacaacaagaaatttttgtattacgtattgaaaagcagcgacgttttagaagtgttagttcctattttataccatctgaacgattccagagctgatcaatcacgagttggcttgatgcacatcggagtatttatcctgcttttactgtctggcgaacgcaactttggagttcgtctcaacaaaccctacaccgctacgattccaatggacattccagtttttacaggaactcacgccgatctcttaataatcgtattccataaaatcatcaccaccggccatcaaagattacaacccctttttgattgtctgcttacaattctagtcaacgtttccccatacttaaaaacattgtccatggtttcgagtacgaagcttctacacttactggaagctttcagcactccctggttcttattctccgcatcctcgaaccaccatctagtatttttccttcttgaaatcttcaacaacatcatccagtatcagttcgacgggaactccaatcttgtatatacgattataagaaagcgccaggtgttccacagtttggccaacttaccggtcgactacagttccatctcgaagtcgatcaacaagcggacgaagaagagaatgtccagctcgatcagtcacgaaaacatcaacgagcaagccatggagggatcacatccagcgctgcctgctgagccgggtacgttgaaggccactctgcccgatactccgcagattgcgcagatgacggagagagagtctgcgcatccggcgataaagcaggaggatggccttacattggcgaacggaatggccactttagcgttaaatacaccatcgaagactgcagttaccataggaaatagtagtattagtgaggtaaataccaatgacgcgtacgagttgaaagaatctccgactccatccccgactggaacactaaccagatcagtgaatgcgcgtaatagtttaagagttagtgcaccgagtgataatataaacggacaatgggtaccgaccagcgaatgggtgcattcgtggaagagcaaattaccactccaaactatcatgcgattattacaagttctcgtgcc

SEQ ID NO: 31 - DNA, 1553 bp, Diabrotica virgifera
  Annotation=26S proteasome non-ATPase regulatory subunit 3
  SmartBlast Evalue=0; Info=26S proteasome non-ATPase regulatory subunit 3 n=2 Tax=Culicini RepID=B0WCQ3_CULQU
gttgtcagcgttacacagcgaatattttcctcatcagttcaatattaacaataaattgttttgttgaaattgaaatcacaaattactttataaaatggtaactctagaagacgttgaaatgaaaaatgcagacagtcctccaggattagaagctggtgatacaaagaaagataccgacctacaaagtgtaatagaaattcgtgaacatgcaagacaaatagaaaaatcagtcacaagtaaagaaaaccgtttcatcttacgagttttacgttgcttgcccaacactagaaggaagcttaatggactggtgctgagaagcctcattactcaaatatatcctgtagctgaacgtgatgccctccttagtttcgtcgaggaagcttctggagaactcgacgccacccagtcacgagcaagatcagctgttaagtcgcctgttcccgaggtagatacatatataaatcttttaatactagtacgtttaattgataccaataagttagttgaagcagagcgctgttctcaagctcttatgaataaaataactaaccaaaacagacgtactatagatcatattgctgccaagtgttatttctatcactcaagagttgctgaattgaccaacaaattggattcaattagagggtttttacattctcgtctacgtaccgctacactcaggaacgactttgaaggtcaagctgtgcttataaattgcctgttgagaaattatttgcattattcgttgtatgatcaagctgacaaactagtgagtaaatgcgtatttcctgaaactgcaagtaacaatgaatgggccagattcttatactacttgggcagaattaaggcggcaagattagaatacagtgtagcacataaacatcttgtgcaggccatgagaaaagcaccccagaatgctgccattggtttcagacaggttgttcaaaagcttactgttgtagttgaactactgctaggagatataccagaacgacagatttttagacaatctagtatgaggcactcccttgccccatactttcaactaacacaagcagttagaatgggcaatttgcaaagatttggtgaggtgttagagaacttcggcccacaatttagacaagatcatacatttacactaattttgagactgcgccacaatgttattaaaacagctataagatccataggattatcatactccagaatatctccccaagacatagctaagaaactggggctggattcagctgaagatgcagaatttatagtagcaaaagcaatcagagatggggtgatagaagctacacttgatccacagggaggttacatgaggagcaaagaaagtactgacatctactgcacaaaggaacctcaactggcgtttcatcaaagaatatcgttttgcttagatttgcacaatcaaagtgtcaaagctatgagatatccccccaaggcgtatggcaaagaacttgaatcagcagaagagagaagggaaagagaacagcaggatttggagttggccaaggaaatggctgaagaagatgatgatg

SEQ ID NO: 32 - DNA, 1542 bp, Diabrotica virgifera
  Annotation=26S proteasome non-ATPase regulatory subunit, putative
  SmartBlast Evalue=1E-179; Info=26S proteasome non-ATPase regulatory subunit, putative n=1 Tax=Pediculus humanus corporis RepID=E0VNS1_PEDHC
aaacgtcaactgaccagtcagataaatattttcatgactagtaattttttgaatatcaaaaaataaaataaaggatacttatttttgtcaggataaacaataactaggctaacaatggagaacatagctaccgattctggaaaaatagtgaagatggaagtggattacagtgccacttgcgacgataaaatccccgagtgtcaaaaactagcaaaatcaggtaaattgcatgatgccctcgatcaattgctggctttggagaagcagaccagaacgggggcagacatgatatccactggtcgagtcttggttgccatttgccaaatttgcaaggatgcaaagaattggtctgcactcaatgaacacatcgttttgttgacaaaaaggaggtcacagttgaagcaagctgtagccaagatggttcaagaatgctgcagctatgtggatgaaactccagataaggagactaaagtgaaacttatagacacattaaggcaagttacagaaggtaaaatttacgtagaagttgaaagggctcgtctgactcacaaattagctaaaatccgtgaagatgatggtgacatacaacaagctgctgacattattcaagaactgcaggtggaaacatatggatctatggagaaaagagagaaagtggaattaatactagagcagatgaggttgtgtgttgccaagcaggactacattagaactcagatcatttccaagaagatcaatactaaattcttcgatgaagatggctcttcagatttaaaattaaagtattacagactgatgatggaggtggatgaacatgagggctcatatttggcaacttgtaaacattatagggctgttcttaataccccaagcattatggcagacgccgaagaaagacaagctgcagcgcaagccgttgttctttacattatattggctcaacatgataatgagcaggttgatttgacacaccgggtgttagctgacaaagtattggaggaaattccaacttacaagcaacttctgaaacttttcaccactcctgaattgatcaaatggtctggcttgtgtgaactgtatgaaaagcagctgaagactactccagttttttctggtaacgatcaggcccagaaaagatggtcagatttaaaatcccgagtggttgagcataacatccgagtaatggccaaatactacacccgcattaccataaaccgcatctcagaattactagacctttctcccggagaaacagaggaattcctgtctcaaatggttgttagcaaaacgatccaagctaaaaccgatagaccagcaggagtggtccatttccaacaaagcaaagatcccagcgatgtcttgaacgattgggctcacgatttgactcagctgatgcagcacgtcaacaaaatcactcatctcatcaacaaggaggaatgtgtccacaagcatcttcagtctacttcagcttagtttaagagttttcagtctgagaatcattttttatttataaaatatatttgcaaataaatgttttgtagg

SEQ ID NO: 33 - DNA, 1268 bp, Diabrotica virgifera
  Annotation=Pre-mRNA-processing factor 6
  SmartBlast Evalue=0; Info=Pre-mRNA-processing factor 6 n=4 Tax= Apocrita RepID=E2C5F4_9HYME
taccagaagttggtgatgccagaaataaaaagcaacgtaatccgagagcagaaaagtttacccccttaccagatagcgtaatatctaacaatttaggaagtgtgtcctccacatctatagatcccaattcaggtttagctagtatggttcctggagtacaaacaccgggtatgctaacacccacaggcgacatggatctgcgcaaaatcggccaagcaagaaacactctgatgaatgttaaactgtcacaagtatctgactctgtaaccggtcaaacagttgttgatcctaaggggtatcttactgatttacaatctatgatacccacttatggaggtgacattaatgacatcaagaaagctagactactattaaaatcagtcagagaaactaatccaaatcatccacctgcttggattgccagtgctaggctagaggaggttacaggcaaagtccaagcagctagaaaccttataatgaaaggctgtgaagtaaatccccaaagcgaggacctatggcttgaagcggctagactaaatccacctgataccgctaaagcaatcattgctcaagcagcccgtcacatacctacatctgtcagaatctggattaaagcggctgatctagaatccgaaaccaaggccaaaagaagggtctataggaaagccttggaacatattccgaactccgtacgattgtggaaagctgccgttgaactggaaaatccagaagacgccaggattctactttctagggctgtggaatgttgtccgtcagcagttgaactgtggttggcgcttgccaggctggaaacttatgaaaatgcgaggaaagtgctgaataaagctagagaaaatattcctacggataaacagatttggaccactgctgcaaaattagaggaggcgaatggtaaccaacatatggtggaaaagatcatagaacgagctattacttcgcttagttcaaacggtgtggaaatcaacagggaacaatggtttaaagaagccattgaaagtgaaaaaggcggccatattcattgttgtcgcgctatcattaaagcgatcattagctacggcgtggaaactgaagatcaaaaacacacttggatggaagacgctgaaaactgtatcaatcaaactgcttttgagtgtgctagaagtgtttacaacatagctttagccacatttcccggcaagaagtcaatatggctgcgagctgcctatctggagaaaagccacggcaccagggagagtttggaaagtctt

SEQ ID NO: 34 - DNA, 1224 bp, Diabrotica virgifera
  Annotation=Sodium-dependent phosphate transport protein 1, chloroplastic
  SmartBlast Evalue=1E-134; Info=Sodium-dependent phosphate transport protein 1, chloroplastic n=3 Tax=Apocrita RepID= E2ANC2_9HYME
ccggaatggttgcaatggtattacttatagcgaatgtcgttcctgcgtaatttggagcaatgtctacatggttactcaaatgcccggccgagttactggctgaaagacccatggatatactgacgagaatgagagcgaacgccaagtgatcaacgacacagaaaatcgctagaaacagagctggtccaatcagtcctatacttgtcatgagtcttcttacatttaaaacagaccaattcttatttccaagcaaaccatcagccacatgaccgcttattacaccgaatatagagttcacaatgtatggtaccgcggttaaacttaaactatgagcattgccccctaagtatctagataaatatgtcggtaaccactgcattataatgtacgatgaccagttcattgcaaagtgagcagtgtatatcgcccacaacggtttgctgaatatgaaatctgcccagcggatgttgtgcgatatcaccttttggctatgtaacggtaaagtttcttcactgctaaagccgtcttcgtgatagaaacagtgccatagaacgagccagaggaatccgaaggagccaaaccagtaaaaacatgcttcccacgataagtgtggacaaactatagaagcaactgtttggccgacagatccagatgccaggaggtatgaaaaggctctcgatcgttcttctaccggtatgttatgagcaaacagatggaatattgtgggtaatcctaacccttctgcaaatccaagtattatcctacaagcaataagagatacaagacttccagctagaaatggtgttgtgaatgttgcaatactccataacagcacgctgcaaattaatacattctttgctcccacctgagttgcccaaaaacttcccaataactgactagtaaagtacccaaatgcaaatgctgacagaatccacccttgagcatgtaaagaccagccaaaaatatcggtcatgggtacaatagctatgggcattatcactctatctgcactgtttataaaatttgcaaaactgcatagtgctactatcctagaggtccttgttaaccaacgtattctcgccatttttaccttatctgaaaattctttgtactaaacaatggcacaactattttactagtagtaatttactcaataattttgtttacatggtctattttcaatttcatccttttggatatgcctgcacagctggcattttagat

SEQ ID NO: 35 - DNA, 1203 bp, Diabrotica virgifera
  Annotation=Protein singed, putative
  SmartBlast Evalue=0; Info=Protein singed, putative n=1 Tax= Pediculus humanus corporis RepID=E0VCB6_PEDHC
gcctcgcttagagtattagcagtacgtgtttagtactcccattgggtggcactttcgatattggtatcacctatacggaatacgccgtttttgctagctgttaggtaatttccggcagaagttttgatgcagaggcgtgttggttctctcagttccagatagaatccttcaggtgcgtcagaatcggcggttacggattcgctgtctgcgtgccagtatttaccactctgagatttgaaatacacgattcccttctctcctctttcgacttggatggtctcgtatgtagctttattgcactccaattttggattcgaagtggatttgtacccgacaaaaccttgttcgcacttaagtactagaatgggtctgttgacgagatagaagaagtatttgcaggtgtcatcgatggcgtctgatgtagcgtagaggtggcctgaacgtttcgtgatgacgtatctgccgttgttggctctgaaggcgaccgaaccgtcggtttgccaagaaagatcgaataatgcgtttgaagaccttttatccccacaagcttgaattccgcctccagtttcaagggtccagtatttgtcttgcattgtgcgaatgtaccatctcttggtattccagtcgaattctagctggaaggtttcgtggtcggaaatttcttcttggtttgctgtgacatcaacaccttgtttgacagacacgaatctggtgttcaaggcggcgacgaagctggcttgtggaagggaatcttccaacgagaacagctcgtctttggtgactgtgttggaccgcgttttgagaactgctttagaacctatagggctcagatactgtccgttgcgatctctgagagctaactgtccgctgtggtattcggcggtaaaaagacaatctttactacaggagtctactaattttccgttcattgagagatacttattattgcaggtatgaatggcatacttcccggattcgtccaaccggaattcgagcgtgaagagcgtatcttcgccccaaggaacgttggcatcgacgtaaatctcgtcgagattttctgagagatgagcgaagcgtttcctgccgaccgatctcagattcatctgcggccgcgctgccaagtggacgtgccaaaattcggcgtcactcggcactttcgctgtgcaagtcagtttgtcggcggaagctccaaggaagtatcac

SEQ ID NO: 36 - DNA, 1020 bp, Diabrotica virgifera
  misc_feature (995)..(995): n is a, c, g, or t
  Annotation=WD-repeat protein, putative
  SmartBlast Evalue=1E-163; Info=WD-repeat protein, putative n=1 Tax=Pediculus humanus corporis RepID=E0VKL5_PEDHC
ctcgtgtatatttaatgtcctttctagttttcctgaatttgtggagaaacaatataagaccatgtcttcgcccacacagtatatccaatctcctcttggagaaacagttgaacatacaaagtcacctccctctcgcttaccactagcaaatgatcttacaatctgtccctgtaaatttataataacaactgtatttgtcctgttacaaactacgaagtgttcaggatttttggcaaaattatggatgttgttgacagctgtatcatttgctcctagagatttgaaagtgttagtgcactcagtcgtttttatactccatacttttactgtaccatcagaagaagcacttaaaatgttgtgtccatcttgtgtgaaaataacttcatttacaaaagatgtgtgtcctctgaactctttaagcgtttttcctgactttaatccatgtattctgatggaatggtcaaaggaagcactgagaacttgagtgttatcccttgaaaactgaagacaggtgatacctttggaatgagccttttcaatcttccttaaacattgtcctgagcttatcctccacacctttatcctaccagtttgagatccagttaccaacatttcactgtctctagaaaatgccatacacagcactgcatgctccatcatcataaagttatcctgtgcttggtattttaaatctttcctaatttttcctgtagtaaagttccacacttctataataccatcgacactgcctgtaaccaaatactgtccatcaggagaaaacctagcacattccacatgtgacttttgtccaaatttgatttgttttgccatctgtgtgggaaacgtttcatcttcctgttctcttactgcagctttacctctgaacaaatcaatagtagtaccaggtggtagtaaaccttggtgctgttgccatttcaatgcttgtccaagcaatgcaagtaacctggaagaaggcaccacagaactcacagaanagcatgtgctatagctgctcttctc

SEQ ID NO: 37 - DNA, 1130 bp, Diabrotica virgifera
  Annotation=Eukaryotic translation initiation factor 3 subunit H
  SmartBlast Evalue=1E-158; Info=Eukaryotic translation initiation factor 3 subunit H n=1 Tax=Bombyx mori RepID=EIF3H_ BOMMO
atttgacggttgtaaatttcttttccaggtggattttataaaaattagtgccaaaatggcaggtcgtagcgcaaatccaaggagaatacccgaaaatgaatcaacaattcaatacgttcaagccgatggattggctgtaatgaagatggttaaacattgccatgaagaatctactaccaatatggacattgcacaaggggcacttttgggattaggagtagataatagacttgaaatcaccaactgtttcccattccctaaacaaactgatgaaaatacagatgaagatgaatatcagctagcaatgatgagaagacttaggagagtaaatgttgatcattttcatgtaggatggtatcagagtgctgatgtgggcaattttttaagtcttccgcttcttgaatcacagtttcattaccagacatccattgaagagtctgtagttgtaatatatgatacacagaagtcctctagaggtttcttaactctaaaagcatacagattaacaccacaagctattgaaatgtgtaaggaaggtgaatcaactccggaagctcttttgaaaatgaaagttggtttcgagaacctatttgtggaagtaccttttattataaagaactctccattgagtaacattatgatgtcagagttagcagacctagttccagaggaggaaggttccaaattcttggacttgggaacagcttcagtattagagggacaattaaggtgtttaatggacagagttgatgaattaaatcaagaagcaatcaaatttaacagataccaacagcttgtaagtagacaacaacaagacaagcatcgttatctacaaaagagagcacaagagaatgcagctagagttgctaaagatgaaccaccattgcctgaagaggatatcaacaaactgttcagaccccatccagtacctcctaggctaaacccaatgatcatagcaggacaggtgaatacatacagccaagccatttctcagttctgttctcagtctttggctaagctgtacattacgcaagcactacaaaatgctaaagaagcaaactctaatttgtgagacttatctatgtaagttatattatactttatgagcattaagagtttgtattcatctt

SEQ ID NO: 38 - DNA, 1320 bp, Diabrotica virgifera
  Annotation=SWI/SNF-related matrix-associated actin-dependent regulator of chromatin subfamily D member 1
  SmartBlast Evalue=1E-157; Info=SWI/SNF-related matrix- associated actin-dependent regulator of chromatin subfamily D member 1 n=3 Tax=Apocrita RepID=E2A8V8_9HYME
gtaagttggtatatttttagtagatttgtttatcggttgtatcttataatatcgtttaaaaactttatttaaaaaatggctcagcggtttcccggccctgtgccaaatcaaagtccaggaggaccgcctcctcagagatatcaacaacagccccctaatcaaggaattcggcagtatgcacaacaaaatttccctcaaagacctggatacaatcctccaccaccaaatataccatctagtggcggtacgatgattcaaagacctgctggtgctccctattcaccaatgagaggtggaattattccgccacagcaaggaaataaaaggcctgcagacaataggactcaaatgcaacagaaaagtaatgaatacagccatagtacaagtaagaagaagaaaaagctggcggataaaatcctgccacagaaagtcagagatttggttccagaaagtcaagcttacatggatctattagcatttgaaagaaagctggactctactattatgagaaaaagattggacatccaagaagctcttaagcgtccgatgaagcaaaaaaggaagttgagaatatttatttccaataccttctatcctgccaaggaacctcagcctgaaggacccgatggaccatgtcaggaaggcactgttgcatcttgggaattaagagtagaaggtcgtcttttagaagatccaaagaacgatccaaataaagttaaacgcaagttttcttctttctttaaatctctggttatcgaattggataaggagctgtatggaccggacaatcatttagttgaatggcacagaaccctaaccacccaagaaacagatggttttcaggtaaaacgccctggtgacaagaatgtgagatgtactattttgttgcttcttgattatcaacctctgcagtttaagcttgatcctagactagctagacttttgggagttcacactcaaactagaccggtcattatttcagctttgtggcagtacataaaaactcatcgcttgcaagatgcccatgaacgcgagtttatcgtttgtgacaagtatttggaacaaattttcaactgtacccgtatgaaatttgccgagattcctcagcgtctgaatccactattgcatcctccagatccaatcgtcatcaatcacgtgatctccgtagaaggaggggccgagagcaaacaaactgcttgttatgatattgatgtagaggttgatgatacattaaaaacccagatgaacaatttcctattgagtacagctagccagcaagagattcaaggacttgatgctaagattcacgaaaccgttgat

SEQ ID NO: 39 - DNA, 1174 bp, Diabrotica virgifera
  misc_feature (1132)..(1132): n is a, c, g, or t
  misc_feature (1134)..(1134): n is a, c, g, or t
  Annotation=26S proteasome non-ATPase regulatory subunit, putative
  SmartBlast Evalue=1E-141; Info=26S proteasome non-ATPase regulatory subunit, putative n=1 Tax=Pediculus humanus corporis RepID=E0W1V2_PEDHC
cagtggtacagcaatcaaatgtaaacgattatttactaaaaaaacaacaagaaagtcctaaagaattaggctcagaatgggccgaacttgaagaacttcataataaaaaattgtggcatcagttgactctaaaattgctgaattttattaagaaaccagaactacagaagaatgataacctcatacaactgtacaataactttattcaaagttttgaaaataaaatcaatcctttgtcattggttgaaattgttgctatagtagtccaacaattcaaaaatccaaaagatgctgtcgcttttcttgaaaagactgaacctaaggttaaaattaattcagatgcccaaaacttgtgcaaagttttagctgggcagatatatatcgaaaagttgaacgatttagatgctactaaaaagataattgaagaagtggaatctacattggacaatgctgatggtgttactccagttcatggaagattttatttacttgcctcacaatattatagaattcaaggaaaccatgctcaatattataggacagcattgagatatcttggatgcatagagttggatacaataacatcagaagtgaaagtgcaacacgctttctttttgggtttggctgctctattaggcgaaggtgtctataacttaggtgaattactcgcacatcccgttttggagtccctaaaatcaacagaaaatgcgtggttggtagaattgttgtatgcttttaattctggcaatattaaaaagtttgagtccatgaaaccgcagtgggaagctatagcagatcttgcagctgaagaattatttttacgacaaaaaatatccctgttgtgtcttatggagatgacatttaatagaccatcgcacaacaggcaattaacatttgcagaaatcgcaaaagaaacaaaattacctttgaatgaaattgaattattgattatgaaagcgttgtcccaaggactagtcaaaggagccattgatcaggttgccaataccgtaaatatgacctgggttcaacctagagttttggactggacgcagatttccaacatgattacaaggcttaacgattggtgtaaacatggtgataccatggagcaattgctggaagaaaaagctantnaaatattaacattgaatttattattaataatttatatatt

SEQ ID NO: 40 - DNA, 1511 bp, Diabrotica virgifera
  Annotation=Elongation factor 1-gamma
  SmartBlast Evalue=1E-139; Info=Elongation factor 1-gamma n=2 Tax=Coelomata RepID=EF1G_ARTSA
gctgtccttttctttctttagctagttttgagtgtagtgagaatggctgccggaactctttacacttatcccgaaaatttccgggccgcaaaaactctgattgccgcacaatatgccaaggcaaacgtcaaagtagcacccaattttgtttttggagaaactaataaaactaaagagttcaccaagaaatttccaagtggaaaggttcctgcttttgaatcaaacgatggcaagtaccttcaagacagcaacgccatcgcttactatgtttccaatgaacaactaagaggaaaaaacgaatatgatagagcacaaattttgcaatggattggctttgctgaaggtgaaattgttccagcagcatgtgcctgggtattccctatcttgggaattgttaaaaataacagtggtaatgatgagactttccaaagagcaaaggaagaccttaaatcctctttgtctattctcaacagccacttacttgcccacacttacttggtaggagagagaatcactctagctgacattgtagttgcctgcaacctattgaatgcctacaaatatgtacttgatcccaactttagaaaatcttttggtaacgtcaatagatggttcaatacacttattaaccagccacaattcatagctgtacttggagaagttaaactttgcagtgcagttgctcaacctggaactttaactgctgcagctgcaacaccaggtaaaggtaagaagaaggaagaaaagaaacaagagaagaagccacaaacacctaaagaaaagaaggaaaaggaacagccagaagaattagatgctgcagaagccgctcttgctgaagaacccaagagtaaggaccctttttctgaactacctaaaggaacctttgttatggatgactttaaacgtgtctattcaaatgaagaagagagcaaatcaattgcttatttctgggaaaaattcgaccctgaaaactattcaatctggtatggtgaatacaaataccctgaagagctctccaaagtgttcatgagctgtaacctaattactggcatgcaacagagactagataagatgagaaagcaggcctttgcatctgtatgcctttttggagaagacaacaacagcacaatctccggtatctgggtatggagaggacaagaattagcttttaccttaagtcccgactggcaaatagattatgaatcctatgaatggaagaagttagatgccaaatcagaagaaacaaagaaattagtagagcaatacttctcatggacaggtactgacaaacaaggtagaaaattcaatcaaggaaaaatctttaaatgatctacatctatttaataaatcttacaaaatgctgtactgatcatgtgaagcaagagaaataaatcccaatgttttgttaataatatttttttattaatatgtaattgttttgatcgaagcttattctttgggctttactccctgagtttataagacacttaaataaatttaataacaatttg

SEQ ID NO: 41 - DNA, 4208 bp, Diabrotica virgifera
  Annotation=Abhydrolase domain-containing protein 2 n=12 Tax= Drosophila RepID=ABHD2_DROME
  SmartBlast Evalue=1E-148; Info=Abhydrolase domain-containing protein 2 n=12 Tax=Drosophila RepID=ABHD2_DROME
ctctagttatttttacaatcaacttttttgacaaataaccaaggcggacgctcaaatatctatgaatgaaatgcgaaacgaaaattttatatttattccattcatcaaaatcaacttaaccccaaacaaaattagtatgattgaataggtattttctatactctgtaaggtcatctgtcactattacataacctgttatgaccacctgagaaactacgtccgtttatttcctccctctaaacactattataagtacaactgttgaaacgatacgaggggtaggggactttgactagcatgtatagggtggccggaaagtccctttacactaaaaataataatgtttcaacaccgactcaacgtttgttggtattcctgcgcatgcgcagcatcaagatcacctgtttggtcacgcatacagacaaccatagttgcgattgaaacgtaatggcggacacaagtgagtatagaattgagaagcgtttggtcgctgcagtgtggatagacgaacgtcgtcataacaataaacaatggccgatattttggttttcaaaaaccatcagcatccagaccaactttgctctcgtggcagaaggctttttcatcgggaaccgttctcgatgcaccaagaagtggaagaccaagccctcgaaaatatgtgctggcattcaggattccattgaacgttcatcgataaagtcgacgcggaaacgctctgcagagttttttattgcacggtcaataacgcaagataacacgagaaaggattaacaagtgaaggccttctttattttcacaagatggcgcctcatcccattttgctctcgatcataaataacttacaaacaaaattgtgttattattctttccctctgtagtacaacaacagcaattcattaatgtaaagcgacttttcggccaccctatatatgaactgctgaacacttaaactaaaagggaacagtcaacgggggttcaccactataatttaagacatactacatattttagactttcttatcactaactatgataatacacatcaaaagtagatcgagaaattgtccacagactggttggtttaactggaaacgaatgagaggggtacagttgtacagaaatatctggaacagcgaaggtcagcgacttcacttggacgccccaggcaatcaagtgacgtcaataacgtcgagaaaacatcagtttatggttgaataaatacacgtgtttgaacattacgtcgtataaacgtattttgtaggtgacttaaatacgtaagattaatgacgttaaaatacgtttaaaacacgttttcatttcagacagcccaagtctgacgtcacaaaaatgggaggagcttaaagagttaatgcttataatgttaatgttgtatattgacatgaccccaaacttcatttatagggcaaactgcatttataacttcattatataaactccaacttttcatcgattgtcatttctttcgagcttctgtcataatatgttgtataatttgtgaataatattaatatacacggattatacgacatatgacagaatctcgaaacaaatgactgtgaatgaaacgccctattgtttacgtgctttgtgtggttaaaaaaagacttttggtgttttggtgtttattttctgttaatgaagtaattattatgtgttgttcacgatactttttgatttaatggacagcgttacgttaaattaagacattatgctggataatttgttaataaattatttattagtttatatgttgcttcagttttgacacagtaagtatacctatataaaaagtgaaaattctataatgttgcattgagggtatttgtaattttattgtaattctatgcatttttttttataaagtcttccatttggttttacttttagcctataagctaaatttaaaacagttaaatgaaaaatatcaataccaacaatgcccatacgaataattattattgtgtatttttaaaaccataaaatgaaaaataatcttaaaaaacgacaaaaaaactacgtttttgatatcacgtatctaaaacgtgataaaaatgacgtcagttatggtaggacatattcacgtgactttcgacgtcgaaaaaacgtgatacactgacatggtttggtgataattatgacgttttttcaacgttttgtaaacgttatttggttgcctggggcgttggtgaaaagatccatttaaaaacattgtggacgaaaccagtggttctccgacatagccgtcaacagctgaaaggaaaggtatacaagagtgtggtcagacccgcgttggtgtatgacggtaaagtgtggtctgtaaagaagattcaagaaaagaagattgaggtagctgaaatgaaaatgttaaggtgcatattgggtaagactagataaaggacttgattagggaaagagtctgggtgactacaatctcaaaaacattcaagaacaaagactgtaattgtaaaaagctgagaaggaagaagtcaaaacaaggttaatggaactatggataacattagcaatctttttgcggtatattcctcaaaggtattccccaaaacaaataccttgttagttttgaattaatcgaagaaaatatttgtgttgatgatgacgaccttttcaaacatgacgaccaatcaatataaaacaattatacacttggtacaatctgttttttaaaaggacttttgtgctcaatgtcaacagtaaaaaagtccagagttagacccacgtactaaaacaataatattaagtgtataaactgtcaaaatggttaaagctctgatgtcacacatcatctcgaggacaagtagttgcatgcaagccacaaatatagttacatatttgttatatttatcataatatatctttatcatatttctaacattgatttcatagccagttcgtctgctgtgagagttagacaaccgactagagctactagagatctgtcgagccatgttactggattcggatagatgaggccgccttcgtaaaagcccaagtgacctccgtgggagacctcgatgtatgcagtcttctctttgtccattgctaatttcttaaccggatctaacaagggaggtggtacaattggatcatccatagcattaataaagatcataggaaccttgatctgctcgaaatagtttttactcgagctccagttgtagtactcggatatagattgaaattgatgcactcttcttgcatacgcctcgtctaactccggcaatgtggcggcagatacgatctcgtgttcgttcaagttgaatcgcttcttcaattcctcggaaagcaacattttgcggtgtcttagaatggtgttctttaagttttcagtcatgacgtataggtagaatcttctgaagttttgccagctcagcatgtgtttggtgccttctagagcgcaatatccttggcaaattgatattcctccgatgacgtttggcggttttggtttgttctctcccaaatattttgttataagattacctcctaaactgaatcctacgcagactaccttcgtttctggataacgcactacgatgtttctaatcattgattggtaatcttcagaatcgccataattaaagattctgggtccagtcacaggaacgttcttcagtactccgacgtggttcaacacgacgcatctgtagccgtggtactgtgcccaatgtacgaatgtgcgtacgtagatactttcagatgtattacagattccaggacaaattgctatgctcacatcatctggaaagtgagtgtctattggttgatacatatcgtaggttaatgttgtgccatcttgcagtgtgaggaataccctttctcccgtaggccaaggacatttcactctaccaataatactatgaaggattgtttgcacgtgaccgctgaaaccccaaagtcgagttggaatgtagtgttcgttgaggacaggtgctatcttctggatattgttgaggaacttattatcggcgcaccatatcgaaggcttgtggggttcactgttaacatttaaaattcggaagagaatacaaatgatgacagctacggcagctaataataccgtcgacatagttgtcacgacacagccggttactatcagaacagcaccactactaaaactaaaactaaaacactgccaaacgcgaaagtaaaatgcatggataataatg

SEQ ID NO: 42 - DNA, 1522 bp, Diabrotica virgifera
  Annotation=Transmembrane protein 184B
  SmartBlast Evalue=1E-165; Info=Transmembrane protein 184B n=3 Tax=Aculeata RepID=E2BBR8_9HYME
aatcatcttatttttatcgacctaaaagtactgtagttcaaataagtattgataatttaattcctcagatcaggaaaatggttgtgttagtgatgtagttgtgaacttaacagcagtgaaaaatcaccaggatcctccataggtgtagacaaaatatttaaatatatatttttgtgtagataaaaacatcaacagcatatgtcaactatggattccacagtgagcagttctagtcctcctttagatttaaattcaacacaaaataccgagatagtagaatctgctctagaacatgatccaatattcttacaaactaaattatgtcaaactgtagctgggctgtttgtctgggcagctctatttttgacctgtagtcaaatctatcatcatctcaggtggtatacaaatccctctgaacaacgttggatcgtaaggatactatttattgtaccaatttatgctatatactcatggataagtctcttattcttcaactcacatacctactatgtatatttcttcacagttcgtgattgttatgaagcatttgtaatctataactttttatccctatgttacgagtacctaggaggagaatcaaatattatgtctgaaatccgggaaaaacctattagatctagctgtatgtttggtacttgttgtctaaatggaaagacttacaccattggatttttaaggttttgcaaacaagcaaccctacagttttgtctggtaaaacctataatggcgtttataattatattcttacaagcttttgggcactatagagatggagattggagccctgatggtggttatttatacattaccataatatataatatatctgtatctcttgccttatatggattattcttattctattttgctaccagagacctgcttacaccttttgaaccagtattgaagtttttcacagttaagtctgttatatttttatcattttggcaaggagttgctttagccatcctcgaaaaggctgatgttatttctcctatggtagatagtaatggagtacgcacatatggaacagtttctgcaggttaccaaaattttctaatttgcatcgaaatgttcttcgccgctgtatctttaagatacgcatttccttacaaaatctatgctcaagggtgccgagccgactcaagaggacgatcagttacgatgcagagcatttcaagcagtctcaaagaaaccatgaatcccaaggacattatgactgacgccatccacaacttccatcctcaataccaacagtatactcagtacagctcaaatgtgatctcgcgacaaccttacgaaagtttgtgacaaacacagttcagtgatgattaactaagtttacttggttagtcattcactgagctgcattccttacgtacttatctacaaaataatgctttacgatctaatttattttaagaaatacatataatacagaaagtatcttttatcttattattgatgttagtcgaaattacatttaagatctagataaagg

SEQ ID NO: 43 - DNA, 2127 bp, Diabrotica virgifera
  Annotation=Pelota
  SmartBlast Evalue=1E-168; Info=Pelota n=1 Tax=Tribolium castaneum RepID=D7ELJ7_TRICA
taaataaataatatattatgtacattatatttgattttacattcctcgcttatataatatacacaatagttgtttacaaaaaataacaattaattacgtttaagaaatagatacaaaataaaacaagtatgaactaaattgtcttaagagctaaattgctcttattgattcataatacaagaccatcaaggaaaaagttttcaaataaagtttacttgatgaattacttgaataacataatgaaatacaaaatcaaaaatacatgatttagcattttactatcataaatacaccttagcttcaaagcaataaacaatgacaaaatgtatatgcagctgaggccattgaatagtttacatctatacgtattagtatctgataaccctttttttaataattaccccgtttaaacgcacattttaagtcaaagtgaggttaccagtggtggacccagaatagatagattcaaattaaaaataaaaatctattttacaaaatctaacggaaaaaaatataaaaatggaaattatagagaaagaagtttttttttaataaaatggattatggtcttaataacgaaaataaggaagtcaacacaattaatatcttatttttttaatacgcgcgaaattttttaccagtattttgacattcagcaaattgtaaaaatgtaaaaattaaagcgtaagctattcagtgaccgcagctgtaccatgtcccaattaaatttcaagttaactaaagtatactttggattgatgaattttggcatttcctgactgtccccatggcaaaaattaattaaaactcacgattgttcttattatcccttaattgataataaaactaacaacatattcttaatactaattttcatcgtcgctgtcttcttccaattctggcattggaaatcgcaaaatagccgcgacaccagttaactgctctagctgttctcctgaaatatgaagactggaaaatattttgacatccccacctgattctctgacagaatccaccaaattaacatattcctttcgcagtttaacatcttgacatctaaacaaattgtctgatataagcaaagtttcaatagcctgttccgaatttgctttttcgacatgttttttaccataaaacgccttggctggttcacattgaagcatcgtgtaaaagttttccaagatttttacctcaccagcagcttttgtgtcagatattttgtttataacagatggatcttgtagtatttcttgtagagaatgtttaaaacccgaagaagaatgaattagcataaattttgacttattttctagcaaaattttattgtctgttttaactgcagtttgaaacatgtactcataaaactgatctttaacaaatccaggagatgcaactagtatacatttaacaatatcgaagttaatgtgtcttagaatggcttgcatcacagtgtcataaaatttagccaaacccttttcatgttgctgcacaaatcctttcctttttctaggaatattaacatcaattttagctcgtacaagagtcatactggatgttatcagacatacatgagcaagtccctcttgcatgatcacagcagcaacatctgcactttttgttggatcgcatgccatatctatacgctctagtgaaacagaatcccattctggttttctgagtgaaaatttcctattaagttccagatctaaggtgtggtatgctcccatcttaacatattgattttcttcgatgtttcttccttttaatcttaacatacatgcctgagtatcaaaatctatattttccactgatattgttaatgttgttcgaactctactagatgtggaggaaccagttgaagactcagattgaacttttctgattgtagtgctttttacggaatctccttcagaaataagattgtaagcatgccacatatcttctggctcttctgggatgagagcaacagtgccctcaccatttttatcgacgtcttgcgatatgagtttcatattgagttagtgtctaacatacttgtattaactacaattactttaagaaatctgtttactgagaacataatttgttgataaattctttgagagatgttcattgttcatgacacat

SEQ ID NO: 44 - DNA, 985 bp, Diabrotica virgifera
  Annotation=DNA polymerase epsilon, catalytic subunit
  SmartBlast Evalue=1E-150; Info=DNA polymerase epsilon, catalytic subunit n=1 Tax=Aedes aegypti RepID=Q17H50_AEDAE
atggtagacgaaacaatttgtgctgcttgtgactacaatagacctggggcactgtgccagcgaaatatggcttggatgatgcgcgaagaatatatgcctgcttctaaaaatgaataccaccgaatccaacagcaattagaaactgagaaatttcctcccgcagtccctggtggacctccaagggcttttcatcaactatcaaaattagatcaagcggattatgaaaaaaagaggttaactgtttattgtagaaaagtatacaagaagttaaaatgtactcgagttgaggaaagaactactactatatgccagaaagaaaactccttttatgtcgatactgtgagagcttttagagatcgaagatatgaatacaaaggtttgtcaaaaaaagcaaaacaagctgtgtccgatgctgttaaaggtggtgacgcatcagaaattaaatctgccaaaaatcgagaagttttgtatgactcactgcagctggcacataaatgcatccttaactcgttttacggctacgtaatgagaagaggagccagatggcacagtatggaaatggcaggaatagtatgttttacgggcgctaacatcattatgaaagctagagaaatcattgaacaagtgggtcgtcctttagagttagatacagacggaatttggtgcatactgcctgcttcttttcctgaaaattttacagttctgaccaatcacgacaaaaagaagaaatttaacatttcctatccaaacacggttttaaacgcaatggtgaaggagtactttactaacgaccagtaccatgacctaaaaaatccggaaactttggaatatgagataagacaggaaaattcaatcttctttgaggttgacggtccttataaggctatggtattgccagctagtaaagaagaaggcaaaaaattaaagaagagatatgctgtatttaattttgacggttctttggccgaattaaaagggtttgaag

SEQ ID NO: 45 - DNA, 1227 bp, Diabrotica virgifera
  Annotation=Polymerase delta-interacting protein 2
  SmartBlast Evalue=1E-147; Info=Polymerase delta-interacting protein 2 n=2 Tax=Formicidae RepID=E2B4H8_9HYME
acctgtcattcgtaccaaaaaatttcaaaacattttggcaaagataataaatatacctattatattattaaaaccatataagtaacaggaaaaacgccaccttctcatattcgtattccaaatgtacaatactcttcgaaaaatcattttgtaaaaatagaaataaattattttcagtattggcaattgaagatgtaaaatggacatagtctcaataacacttcgttgcaatgttattccagtcgtttctagattacttgtagcacgtagaaattacgcaagattggcagaagttggtaggttagaaacaccaaaggtctctgggaagtatgaaacaggacagctgattttgcatagggtcttcggttatagaggcgttgtactatttccatggttagctcgagtttatgatagagatttaccaagtcggaatgaaggagatgaagaggcgtctgcagcagtgggtaaagaagtcagaggaagaacacataccttttatcaagtgctgattgatcagagggactgtccctacattagagcccaaacagaggctgtaacattcttaggtaatcaagattcgtccaggagtttatatgcaatcccaggcttagactatgttgcccacgaagatattatcccctatgctagtgcagaaaagacccccttgaaccatgaactttttgataaattcttaatggcaaatccaaaaggtgatcctccgtttgttgcccaagaaacattaaaagcatggcagaacaaaaatcatccttggttagaactttcagatgtacacaaagaaactactgagaatattagagtaactgttatacctttctatatgggttccagggattcccacgcaagttcagtatactggtggagatattgcatccgattagaaaacctaggctcccttagcgtgcaattgagagaaagacattggaggatattttctttatctggaaccttagagacagtaagaggtcgtggtgttgttggacaagaaccggctttaacaagagcgcttccagcttttcagtatagcagccacgtcagtttgcaggcccctagtggacatatgtggggtacctttcgaatggagcgagaagacggatatactttcgactgtagaataccgccattttcattagaaagcaaaccggatggtggctctgcatcccctccagatactgtttagagtatactctgtacataaataatattcaa

SEQ ID NO: 46 - DNA, 1704 bp, Diabrotica virgifera
  Annotation=Methylthioribose-1-phosphate isomerase
  SmartBlast Evalue=1E-155; Info=Methylthioribose-1-phosphate isomerase n=1 Tax=Aedes aegypti RepID=MTNA_AEDAE
gaaaacggttatcgtaatctcgtaatataaaaaatgcacagtaattgagttatttttacttatatttgaataaaatatatatttaaagatgtataaattcaaattacacctggaagtatgttcttaatgtattaattaaaataatctggcaatggtaacacacgattaaattaaaacatacatttctcagattgctgtcatttttgccggacgtagagccaaaactattaattaaacaatctaatgtttattccaattaagtaaccgatatcaacttttgtgcagataagatgtaaattatttgtctgtttgcttttatcaaaccgccaaagaaatcatcttcaacagcggtgatttgataagtgaggttaaaatgactctgcgggcgattaaatatgataataattcgctagagatcttggaccagctgcttttaccagcacaaactaagtatattcaagttaaaggtgtcgaggatggttggaaagttataaataaaatgcaggtacgaggagcacctgccatagctatagtaggatgtttaagtttagcagttgaattgcacagtgaaaaatatgattccaagaagcagatgagacaggagatcgaggggaaactcaactatttagtgtcttccagaccgactgctgttaacatgaagattgctgctgaagatctgatagatttggccaaccagctgtgcaatgatgaaaaagttgatgttcaggagatgaaagcaaagttcacaaagactattgaggatatgttagcgaaggacatagccgacaatacagctataggtgattacggtgccaaagatattctatctagagttagtggagataacctcgtacggattttgactcactgcaatacggggtctttagctacagctggttacggtactgccctaggggttgttcggaccttgcacagcatgaaaagactagaacacgtatattgcactgaaacaagaccctacaaccaaggggcaagactgactgcttacgaactagttcacgataaaattccagccaccctcatagttgatagtatggtagcagctgttatgaaattcagacacattagcgcggtcgtggttggtgccgatagggtagctgcaaatggagacactgccaataaaataggaacctatcaaattgccgttcttgccaagtaccacggcgtgcctttctacgtagcagcacctttcacgtctatcgatgtatctatacccagcggagatcacatcgtcatagaggagagacctgatagagaaatgacgcacgtgggggaacatagaatagctgcgaaaggtatttcatgctggaatcccgcttttgatgtcacacccgcagcattgattgaaggaatcattactgagaagggcgtattcaaacctgaacaacttaaggaacaatgcactcaaaataatcattaaataacggattgcgagacttatttcaaaaatagacaatattaacggaaaattaattttgtagtaatgtatttctgaaaatcgccgagcaagtgatacaaaatataagttatatgtaagaatgttaaagtaaagtgtgttttttagaggtgtagaactttgagatgcaataaaacaaagatgatttttttaaattgacatgcaattgattttattcgaaagataatcaatctttaggcattataatttaaatatgatttctggca

SEQ ID NO: 47 - DNA, 1407 bp, Diabrotica virgifera
  Annotation=Chitobiosyldiphosphodolichol beta- mannosyltransferase
  SmartBlast Evalue=1E-123; Info=Chitobiosyldiphosphodolichol beta-mannosyltransferase n=1 Tax=Harpegnathos saltator RepID= E2BIR3_9HYME
cgttgagtgagatgttatgattaggggttgggtctgaaaaaagccgaaaagagattaattgaatataaaatttgataaattaacaattattatcaaatatggaaaaaaagaaaaatgtatgtgtggttgttttgggagatataggaagaagtcctagaatgcagtatcattccttatctctggcagaagcaggacacacagttgacataataggctatggagaaactgaaccaatggaagaaattaaaaaatctccctcagtattctaccactacttattgtcaccacctactttaccacataagttattaaattacgtacttaaaaccatctggcaaactcttaatttattattcttgcttatagtcactagaaagcctgatatactgattgtgcagaatccaccagcaattccttcgttgttagtttgttggttgttttgtctaatttttagaagtaagtttgttatagactggcacaactatgcacattccataatggccttaaatctttccaaggataatgtcctagtaactattacgaaaaaagtagaatcatttgctggaaaaagagccgatcacaatttttgtgttacaaatgcgatgaaaaaagatctctgtgataattggaatataagtgctacaactttatatgataaaccaccaacagtttttaaatcaataagtttggaagaaaaacacaagtttttgagcaagttaggagaaacctacagacagttattgtgtgatgatggttctacagtttttacaaaagataccagtactggtgtaaatattaaaaatgatagaccaggattattagtatctagtaccagttggactgaagatgaagatttttctgtcctttttggtgcattgcaagaatatgaaaaccacattgtagaaggaaatgtaagaaaattacctgccctattctgttgtataactggtaaagggcatcttaaagaatattattgtaaaaaaattgaagaagaaaactggagtcatgttaaagttctaacaccttggcttgaatctaaagactatccgttgatattagcttctgcagatttgggagtgtgccttcatacaagctcaagtggtttagatctgcctatgaaggtggtcgatatgtttggatgtgctctacctgtttgtgcttatgactttaaaagtttgaatgaattggttcagcacggaaaaaatggttttaagtttagtacacctgaagaactatccaaactcttactggactggtttcaaaacttccctaatgatccggttcaacaagaaacagaacgaaaattcaagaatgaactagagacgttccaaaaattaagatggagagagaattggactcaatgcgcagctcctgtgtttacatagatatatgtacttgaacattcca

SEQ ID NO: 48 - DNA, 1298 bp, Diabrotica virgifera
  Annotation=Failed axon connections protein, putative
  SmartBlast Evalue=3E-97; Info=Failed axon connections protein, putative n=1 Tax=Aedes aegypti RepID=Q17FB4_AEDAE
ccttcctatttcccttccttctccttattctcttctgacttttctttagccttatccttttctttttcgtcagccttttccttctcaatatcttctcctctggttctttttctttgtcactctccttctcgtctttgctttcctctttgttgtcttttgattcttccgctttgggtttgggtaaatgagaattcaagtccaatgttgtgcaaatgtcgtcccagtcagagaagcatcgctccttcatacggttaaccaaaccgaccaagttggggcaggattctgtcatgaaatctctcaatggatagctcacttctttgtcgatgaagtagatttgagccaggtgtgcgaaaacgacgacgtccaatgtagtgggttcgtctccgaagaagaatggtttgtcggctaacatttctgacagcactttcaaatcctcctggccgaattcgttaatttcttccgccgaatgaactcccattccttgtgctttgacctttttggttcccttcctaccaaaagcaaatttaaagaagaaattaagaataccgttgggtatcctggttccaagtgcgtgttgcaaattaactttgtaccccttgagcacttgatcaggatattttgtgcgccaccacattacaacccaggctagatggttctcgatcatggaaattgtggcgtgggccagatttctctgttccgctgtcaagcacacatcgagatcatgaccgaatttttgcgaaagatccttgatgatgatggcactgtcagctatttcttctccgttcagttctataaagggcagctggcccttctttgagcggtatttcattttgtggtcgacattctcgtatttgacgccagctagtctcaaccatgtttcgactttcaaacaatagggcgaaagggatggtagcagtggtgtacgcgaaaactgatacaaataaacgacgtctttttcgaaatttggtttgtgtaccaatacttttggaggagtcggttctttttcttttgccgaggcaggcgcgtcgccggcattttcttgtttaccggcctcatcggctttgttgtcgccggacggtatctcctccttaatttcctttgtttcgggtgcgttattttcgacctcagttgccatcgctagttctatttcaagtaatataaacactcaacaacacacgcgataagcaccacaacaaacaatgtacaacaagataaaactaatactcgactaatcaagggacaaaaagcagtttccctgcaatagcttccagctctctagaatagaagagtcgtctcgt

SEQ ID NO: 49 - DNA, 1523 bp, Diabrotica virgifera
  Annotation=Dolichyl-diphosphooligosaccharide--protein glycosyltransferase 67 kDa subunit, putative
  SmartBlast Evalue=1E-112; Info=Dolichyl- diphosphooligosaccharide--protein glycosyltransferase 67 kDa subunit, putative n=1 Tax=Pediculus humanus corporis RepID= E0VHQ8_PEDHC
actacgtcaagttccttttaagaaacgtcaattgaatcaactagacggtgatgtgttcagtaattgaatgtaaaatttaaaataatgttgaaattaatcaccttcatattcataatagtgaccgtcaatgcagcagaaagaatcaacaataatttaatttataaaaatgtggatagaaccatagatttaacgtcacagttagtaaaaatcaccagcaccataactcttgaaaatgccggcgcagaccctatcaagaattttctactggcggagcaaccaaatttagttgggcagatagcatttaaaggtgccaaagactctgccaagcaagatttaaacgtcttaacagcccaagtagaaaaccagagtgataagagattccacaaagttatcttgaggcagaatttggaaccgggccgtactgcaacagtggtggttgaagaaatactcattaaaagtttaattccatatccaaatagtatttcccagaaagagaagcagttagtgaggtattttggtaatcattatatttatacaccatacacagtggttaaacaaaaaactgatgttacattaagctctagaagtattgaaaattattctaaattgaaaccagttactcagacagatagtacagtacattatggaccatatggagaaattgcaccttttgctgtggatgaactgatagttcattacgaaaacaatgctccatttttgacagttgtccatctagatagaacaattgaaatatctcactggggtaacattgcagtggaagagcaaattgaaattaaacacacaggagctacattaaaggggccattttcgagatatgattaccaaagagacactagtagtacacatcacagtattaaatcatacactactgttttaccagccactgctcatagcatttattacagagacagcaatggcaacatttctacttcagctgtaaaacaccgtaaggattggatagaacttgaactgagaccaagattcccactttttggaggttggcaaagttcttatactcttggctacagtgttcccagttaccagtaccttttcaaggctgaaaatggagataatgtattagctatgaggctcattgaccatgtttttgacgatatgtatgttgaagaagttgttactaacgtagttcttcctgttggagtcactgatatcaaaattcgaccaccctatgatgttgagagactatcagatgatgttacttacaaatatttggataaccttgggcgtaaagttataagactgaaaaagagggacctgatcgaacaacacattcaagatttggaaattacgtataaatggcaaccacgattgttgttacatgagcctttgctgttatcgttggcactctttattttgttcgtagctgtaattatttgggtccgattggacttttcacttgcagtgcctgagcacagcaaaagagaataactttttgtacatctatattaacattttttgttaaataaattataagattgtaaaaa

SEQ ID NO: 50 - DNA, 1853 bp, Diabrotica virgifera
  Annotation=Membrane-bound O-acyltransferase domain-containing protein 2
  SmartBlast Evalue=1E-147; Info=Membrane-bound O-acyltransferase domain-containing protein 2 n=1 Tax=Camponotus floridanus RepID= E2A0X9_9HYME
aagagaacgtagaacgtaggtcgtgtgtgaagatttgttttgacagtgtgtgtgtgactcaaatgtcaagcgtgaaaactaagcaaatgttaactgtgtaaagaaaaaaagtgttaagatgagcgcaagaacttccagctaccaaggcagccaaatattcgcaggtctggcacaatatgccggacttgagactgatcaactcaattttctcataagccaaatcgttgctctgctattatctacactttatagaacagtactccaccctagcaagacgagaacggaaatcagacatgcatttggattagttgtagggttgtgcatggggtatttttgctttgggtttcaagctatacatttggcaggtctaccaatgatatgttacatgataatgattactcaaaatccacacataatgcatggaatggtgctcacagtggccttaatctacctatcctgcgtccacctacatcgtcaaatttacgattacggttcatacgggttagacataagcgggccgttgatggtgattacccagaaagtaatctctttagccttcagtcttcacgacggtcttaccaaacaacaagaagaaatgacgcacaaccagaaataccacgccgtgtacaaaactcccaacgtcttagaatattttagttattctttgttgttcccctctttaatggcgggacctatcattttttacaacgactatgtagattttatagaggggaacaactatgtgaaggccaggaatagcgtagaaaactcgaaagtcgtacgagaacctagtcccgtgaaagctataatcaaaaaagttgcgatcgctctgttttgcgcttacattttcctgaagttcctaccgagattcccgattgcgcgcgtgaaagaccaacattttgtcgaaaataccagcataagctatatattctggtacttgacagtcagtacaactctagttaggtttaagtattatttcgcgtggactatagcggatgctatctgcaacaactgtggtataggcttctcgggatacgcggaagatggtacagataggtgggataagatttctaatgtagatatatttcagtttgaattcgctactagtcttaagcagggcattgaggcttggaacaaaggtacaaatatttggttaagaatgatagtttatgagagaacaaaaaagttccctactgttttaacatatgtattatcggctgtgtggcatgggttctaccctggatactatttgacattcctcagtggcgctgtgtttacttttgctgctcgaactgtacgacgccatgtcagaaactactttatgacaactaaagaggccaaactattgtatgaccttataacttttgctgtgactcattttgtattcgcttatcttactttcccctttgtttctttagaattctggtcttccatagtattatataatagaatgtattggtgtcttcatttaggagctatcgctgcaatgatattcctaccacaatgtgtgcctaaatctcaagcaagagaactatcttctaagagtggtatcgctttagctctacgacaagcgggaccatattccagaaacgaatgactgaataatcagagaatttgacaaaaatcatttatattttatacgcacaaacgcacaaatttctctaacgaaattcgactgatttttttacaatgttgcaaactctcaaagtactgacaattttttataagttttttcaaaatactgtttcaaattatttataccagctaagttaataccaaaaaatactcgaaacgaatccttgaaagttttaaatatttatgttaaacgtttgatcaaaatatagtattgaatg

SEQ ID NO: 51 - DNA, 1351 bp, Diabrotica virgifera
  Annotation=Coproporphyrinogen iii oxidase
  SmartBlast Evalue=1E-139; Info=Coproporphyrinogen iii oxidase n= 1 Tax=Aedes aegypti RepID=Q16JA9_AEDAE
ctcacatttagcttagctgatttgtacaatttagttcaatgagagagttacattttttaacagacaaatagataggattaaaatgtttttcaaagtatttgtaaaaaatttcacattagttttctatcaaagagaacagaagctatcaaaattgctgaaatatggaacagtattcacgggctcagcagcatttttgtctaacaaatctaagtcagttgatacaaatgaatttatggctttaccaataacgcctttgcagaaactatcttccaacccagatgatatgaagactagaatggaacttatgattatgaaggtacaaaaagagttttgcaaagctctagagactgaagaagactgcaataagtttatcgtcgacagatgggagcgacaagagggaggtggtggcgtaacttgtgtgttacaagacggaagagtgttcgagaaagctggagttaacatttctgtagtttcgggaaatttgcctgcaggtgctgtggctcaaatgcgctccagaggtaaaaaacttgacagtaatggacctttacctttctttgctgctggtataagtgctgttatacatccagttaatcctatggtaccaacaatacattttaattatagatattttgaggttaaaagcggtgacgaaactcaatggtggtttggaggtggcactgacttaactccatactatttgaattcagcagatgcagtccattttcatcagacgttaaaagatgcctgtgataaacatgacaaaacctactatccaaagtacaagaaatggtgcgatgactactttaacataccacacagaggagaaagaagaggtatcggtggtatcttctttgatgatttggatactcctagtcaggaaaaatgtttccagtttgtgaaaagttgtgccaatgctgtgataccttcttacattcctttagttcaaagacataagctgacaaaatataccaatgtggaaagggagtggcagttgctgagaagaggaagatacgtggagtttaaccttatatatgacaggggtacgaagtttggtctttacacacctggagccagatatgaaagtattttgatgtctttgcctttgaccgctagatgggaatacatgcatgcccccaacgaaaatacaccggaaggagaactgatgaaagtattgaagaatcctaaggactgggtggattgtacgtgtaaagatgaaaaacaataattttagagagagatagttaaagtctgcttgtttgctctctttaattccctttttgtaattccataattatgtaagaatggtttgtttatatattttatacacaagggctgttactgtacatacaaa

SEQ ID NO: 52 - DNA, 1725 bp, Diabrotica virgifera
  Annotation=Mitochondrial sulfide quinone oxidoreductase
  SmartBlast Evalue=1E-143; Info=Mitochondrial sulfide quinone oxidoreductase n=1 Tax=Glossina morsitans morsitans RepID= D3TMK7_GLOMM
gggggagagagttattcgcttgcgttagagagcactatttaattgttaaaagcacacattgctcttatttgcacatattattattgcacatattgcacatacaatgaaaaaaatataaaattcactgagttatagcaagttatctgttaagctaccacctacccttaaacacgtacatctaattctatgagtcatttttcttatcagtcaactgaagatgcattatccttctaaacagagcaggtccgttccagtatccgttgagcatcacatgccaatatagttctggcataaagtttttctttaaaatatacattgttttcaattctctatcttggctgaatggaaaggtctcgagcggttgtagatcgtagtcgaactcggccaaaatgcatttaccataacctgtaaccagtggacaggacgcgtagccatcgtaagtcttgcaaaggtcttggcctttcattactgcgcataggtttttgaataccactgcagtctgtgcagctgcagctgcagcagtttttgaatttggagtcgaactgcaatccccaatggtaaaaatgttcggatacttgacatgttgcatggtgtatttgtgaacatcgacaaaaccagcctcgttgcatatttttttgtttttggataaagactctggtgtagccattggaggtacagcatggagcatggagaactttactgtttttttctcttccggtttatccaaatttgtgaaagtagcttcgtttttagtagcatcgacatgcgttaagttcgttcttaaattaacgttaacattgcgttctttacagactttccaaagagcatcagcgtacctcttgacaccaaaaatgacgggtaatgatgtgttgtatgtgatggttacatcgttccttttgccttcctttctaaaatagtcctcagcgatgtaacaaattttctgaggtgctccaggacattttactggagagcttgggaatgtaaagtgaacctcgccacctttaacatttttcagaacttcaaaaacgtgtggcgcatatttgggtgaatatattgagcatactttacttggattatccaacgcttcttgcaatccaggaaccaaatcatatcgaagttccaagcccacggctattatgatgtaatcatattcgatgacgtggccgttttgtgttctaacagtgtttttatcaggatcgaattcaactgctttatccttaacccaagtacaattttttggtagtacgtcgcgttcgtttcttctagaggcttcaatatttgatattccaccacctattagagtaaagagaggctgataataatgatcttcacttggttccaatacaattaaatcattctttgccattatgcgggcaaattttgctgctgtagaacatcctcctgttccccctccaaccaccaataacttgcaactatatttgtctctaaatgtagacgaagtcgaaaaatttcgccccgaaaggcgcacacttttaaaaacaatgtttcttaacatatttaacacaaatttcggtattttacgttattcctaaccacagagatgtatgaaactgtcctcagtgtcttctaaaataaatttatgtaaggttgtaaatcatttcagataacatatactgcatcgataatcggtgtgctatttattctattagcaatcagttaaaaatatactatttttttaccgagaattttgacggaataggcaac

SEQ ID NO: 53 - DNA, 1457 bp, Diabrotica virgifera
  Annotation=Coiled-coil domain-containing protein 47, putative
  SmartBlast Evalue=1E-128; Info=Coiled-coil domain-containing protein 47, putative n=1 Tax=Pediculus humanus corporis RepID= E0VE15_PEDHC
caactacttatagaaatagagatcaaaattcgatccttacaaagctttaactttgagttgcttcatctttggccccctctttttagcctgtctcttttcttctttaatttcccatcgtctctgtcgttctggatcctcctcggccatgatcttttccttttctaaacgccttttttcttctttcctcgctgcggccgcctcagctctagcctggtgagtcgatttcaggaaggcttcttccactttttgacggttcttgtcagctttggatttggcttctttagacagtctgatacgtttaaccttatctatggtgtagaaaaccatgttcatcaatggagttaattttacacacgcctcttcaagaggcatccctttcacgggtatattgaaaccgaacataattactttttcagtatcaggcaatttcaaaagtccggtctcttcagtctgtttcagtccagaaaattgatcggaaatgtggatataatctatgtattcgggatacttattaattacagtggacaccttgtgatccaatatggcagaagcggcttccccgatttcgctcatcacgttgaaactggatggcaaattgaatttgtcgcccgatttacgctcgggacaatacacgctcaaatcggccatgtctttgactagactcgttgctgtttttttggtggccaggcagaacacaaagttgtccatgtcttctttgttcatacgtatggtgaagtggatttggtccatggtgggccgcatcatgccggataatgtggctagcaaatcctgtcttttaataagttttaattccactaacatcccctcgcagcaagttcttccactgcaccacaaagtaaagatattctcactctccttggttaaactggtattttcattcctatctaaagtcccgtcatctcccaccaacgaaaagttatcttcgaacaattgcctgtgagtattgaaccatgtgttggctatcttactgtttttgcttttgcctgtggcaaagttgatgaaatatacaaccaatccggccatcatgagtatttctagatagtagctgtcccagttttggcggaagttgagtggaactttggcaattgttatttttggttctgattcgacattttcttctttcaattcgtagccttcgaactcttctccatcttggaaatgttcgaattctgaatcgtcatcatcgactaccatatccggatcgtcctcattctctggcacttgttctggaggcccctctgtgtcactttgtacttcttcagaaatgatctgttcatcttcaacttcgaaatcctcgaattcagcaaactcgttgtctgcctgatcgtgaaaatcattagttaaaccactctgaattagcagaataaaaagaataaaatatcggagcaacatcgtatcactaatttggaatttacttgtatattgtgattgtgaag

SEQ ID NO: 54 - DNA, 1322 bp, Diabrotica virgifera
  Annotation=Eukaryotic translation initiation factor 2 subunit 1
  SmartBlast Evalue=1E-142; Info=Eukaryotic translation initiation factor 2 subunit 1 n=2 Tax=Apocrita RepID=E2B063_ 9HYME
agctcctagtttttggacacgtgaaggtatgccaagaaaagaaataaacagtatttgtttaaatataaaaactattttaagggctgctatataatactgtattttggtattcactaaattatagtactaattaattttcaaatttaccaagtaaatctaacctcaaatttcagcatattcttggaatcttcacaatcccaaaatgccgctgtcgtgtcgattttataaagaaaaataccccgaagtggaagatgtagtcatggtaaatgtaagggccatcgctgaaatgggggcatacgtccatttactagaatacaacaatatagagggcatgatcctgttgtctgaattgtccagaaggcgtattaggtcaattaacaaattgattcgtgtaggaaaaaccgaacccgttgtagttataagggtagacaaggaaaagggatatatagatctttccaaacgtcgtgtaagtgctgaagatgtagaaaaatgtacagagaggtttgcgaaggccaaggctgttaattcaattttaaggcatgttgcggaattactaaagtatgaatcagatgaacaattagaagaattgtatcagaagactgcttggtatttcgaagaaaagtataagaagaataaagctagtgcatatgacttcttcaaacaggctgttttagaccccagtattttagcagaatgtgaattagatgacaaaacaaaagaagtcttgcttagtaacattaagagaaagctaacatctcaagcagtcaaaatcagagctgatattgaatgtgcttgttatggttatgaaggtatcgatgctgttaaaactgctcttaaagctggcttggctctttcaacagaagaattacccattaaaataaatcttatagctcctcctctctatgttatgactacatctacacctgaaaaacaagatggtttaaaagttttaggagatgctatagaaaaagtcaaagcgacaatcacggaattgggtggagtatttaatattcaaatggctcccaaagtggtcacagctaccgacgaagccgaactcgtcaaacagatggaacgagctgaactcgaaaacgcagaagttgctggcgacgacgacgaagaacaagacgagggacaaatctacagcgaagaagataaagacgataaagaaaattctggtgaagaggaagatgaggaataatatttttctttgcgattcaaaggcgtaaagaaaaattgtatattataagaatttatttaagccactatcaacagtacattatttgatttttttaattttgttttatctttgtacatgtttgaat

SEQ ID NO: 55 - DNA, 986 bp, Diabrotica virgifera
  Annotation=Branched chain alpha-keto acid dehydrogenase E1 beta subunit
  SmartBlast Evalue=1E-126; Info=Branched chain alpha-keto acid dehydrogenase E1 beta subunit n=1 Tax=Glossina morsitans morsitans RepID=D3TPF3_GLOMM
ttcgtgtgctataagaacacgttttgtttttttcaccgacttaaatactgtctccgtatcccacggtaggatagaaaccaaatctattacttcacaggatactttcaatttttctttggccaactgagctacctctttgagtacatggacctgcgttccccatcctattaaggtaacgtcattaccttctactaaaatatcagcttttcctataggtaattgataatcatcgacaggtacttcttctacagcttgtctgtataaaatctttggttcaaatactaaacatggatctggatctctaatacaactaagcaggagtcctttggcttttattggtcctctaggtatgacaaccttcaaacctggtgtgtgggcaaaataggcttctgggctttgggaatggtacagagctccgtgaccaacagctccacatggtgctctaactgtaagtttaccacagtcgaaggttcctcctgatctgtatcggtattttgctgcttcatttactagctgatcaaaggccggaaatatataatcagcgaactgtatctcggctattgtagtcgatcccattacagcagcgcctatcgcgaacccggctattccttgctcgcaaagcggcgtattaaaaactctatcctttccgtatttatccctgagtcccattgtacacctaaacacacccccgaatccgatatcttctccaaatataagggcagagtcgtcagtctttagtgcggtatctagtgcattgttgatggcttggaacatgttcattttcgttgtttcacctttgactggactatttgtatctggcgtgtaaacgaaatgatttcttttattcactaacccatttaaaactctaatttccgttttcaaaggtcctaagcacttaacacatagtttattcaaagacattttcactaagaactctgcgtcctctgctcaaacgtcaggaactcgcttgcttgtagtaatctctt

SEQ ID NO: 56 - DNA, 1818 bp, Diabrotica virgifera
  Annotation=Zinc-type alcohol dehydrogenase-like protein C1773.06c
  SmartBlast Evalue=1E-121; Info=Zinc-type alcohol dehydrogenase- like protein C1773.06c n=1 Tax=Camponotus floridanus RepID= E2ANJ7_9HYME
gtgtaagttgtatgatcgttgttaagaagaccaaacgaggagggtgattgttaattattaagaataacaaatttaggaacagatccagttcaagtcagtagtcagtgtataaacaaaacaaatcagaaggaatactgaaggttgttgaggtcaattgtaataattacttattactttctcagaggagagaaacaacatgaacaaactttgccgccaagtttctatcgagtcacccgggccagtaatcaaagattgtgtcttcaattttgaaattccggttcccaatgttcctccaaatggagctaggattcgtgtagtatgcgctggtgcgtgctacagaatgagaaacagatcttcatctacatccagcgtatcttctattagcagtgtacaatctacagaagatacaggttatggtccagcacatcatggtgtaagagatggcgccttatttcctggatatgaagtagctggagttatcgatgagttggattctgccgtctcttcaaatgacttcaaagtgggaacgcgtgtgatactatatccgtatgaaggaattccacatggatatgcagagtacattgttgtccctgatctggaatatctagtaaaagtgccagattccttgccaatgagtgttgctgcaatgttgcccacaggtgctcttttggctaaaaacgcagtcgtcacagcccatcagcatgtcactgacttattaaaagatagggccgctgatcatatcgtaagaatccttattgttggtactggaggattagctttgtgggctcttagaatagctgaatatcactttaagaccccagaatacaaggacagagtaaaaattactgttgctacattaaaagatgaaggtcttatgatggctgctgccgaacttaaatgggttaacattgtccaatggaatgaagacttgtatgaaaaacagctaatagaaagaaccaaagacgcttgtagcggcctagtggacatagttattgattttggcactacttcaagatcactacacagatccttacaatgccttaactcgggaggtgtagttctggttagtgaggaagtggctgaacgccttctaccaaagttttcacgcttgattcagcaaagaaatcaaaaaattgaagcagtcgctcaagggtcaattgaacaactcaaacaattagtccaatacgtcgcacagggtgatattaaaccaccaccatataccgaattttctgccgaagaagcatcatctgtagttcaaaaactatgcatgtccgaaatacctggtcgggctattttacgttttcatgacgtacagtaaagcttaagttgtatttggaaaagtgactatttaataactaaatgttactcataaatgttcataataatcttatttttcatatttgattgttgggatgtaacattgaatcatttacataatatatagtagaatgttgccaccaagctagaaatgtagagagtgatgtattgtcgttacgagagaaattaccatgtttgaagaaagtagttacacccaagttaacacttgtatttctacactacgtttagaactgatagttaattttagagccttccattacttttactttgatttgacgaaatgatcttgttttcaccaaatatattttgtgattagtattattaaatgtagaagtaagtattatgtatttaatccatataaatagtctttctagatggaatcgtactccttaaagatatgtgatatgtttatattttttattaacatatattttatatttattctaaaacacagcatttttattttgagttattttgcat

SEQ ID NO: 57 - DNA, 2123 bp, Diabrotica virgifera
  Annotation=Ef-hand protein nucb1
  SmartBlast Evalue=1E-102; Info=Ef-hand protein nucb1 n=1 Tax= Culex quinquefasciatus RepID=B0W5I9_CULQU
ccagtgacatcagttctcagtccattcattagcaaattaaaaagtgttgaaaggttagtatttggaaatattgggtcattattaactggaaaagttgttctgtatgatattctaaaccatattacacttatttaatagaataaacaaaaaataccttcgtttcagcttatggaagcatactaaaatatcaaaatgaaatggttgtatttgtgttgtttgctactgattcttcaagtctgcactgcacctccagtggagaaaaagaaggaagaacctgaggattcagaagtaaatggtttagaagattatatggaatatcacagatatctaaaggaggttgtgcacgccttggaatcagacccggatttcagagcaaaactagaaaaggccgaagaatctgacatcaaatctggaaaaatagcggaagaattagaattcgtctcgcatcacgtcagaaaccgtctagacgagatcaaaagagtggagttggaaagactgaggcatttagtagaacaaaagaggaaattggaagacaccaatgccatagacaccgaagaccccacacacaatcatctggaccactcgaatccacatacgttcgaaatcgaagatttgaagaagctgattgctaaaactgcacaggatctggatgaggctgataagaaaagaaaggagcaatttaaacagtatgaattggaaaaagagtataagaagatggataagttgaatcatactaatggagacgaaaggcagaaattagaaaaagaatatgaagaaatggaaaacaagcataagcgtcatgaaaaactccacgaacccggacacaaagctcagttggaggaagtgtgggaagagcaggatcagatgcaacaggacttcgatcccaaaacctttttcatgcttcacgatatcgacggtaatggcttgtgggatcaagacgaagtgaaagctttgttcattaaagaattggacaaaatgtaccagcaaggtgctcctgaagacgattggcgggaaagaatggaagaaatggaaagaatgagggaaagcgtttttagggaaatggacacgaaccacgatggttttatagattttatggaattctaccgacaaactaatactaatgacttcaagcaagaccatggatggcaaggtctagacgaacaaaaaccttacactgacgaagagctagcagaatacattagacaacacgaacagtaccaacagggaattccccaaggttaccatcctggagcttaccaagttcctccagcagggtaccaacatccacctccaggagcaggataccaacagcaacatccagccggaggttaccaacaacatccacaagcaggataccaacaacctccaccaccaggatatcaacaccaacctcccgtagggggataccaacaacctccacaacaaggataccaacaaccaccacctcaagtaggaggataccaacaacagccaccacaggcagcaggatatcaacaacctccaccacaagcagcaggataccaacagcaaccaccatcaggaggataccaacaaccaccaccagcaggaggataccaacagccacctccaggaggatatcaacaggtacctcaaggtagctaccagcaacccgtagctcagcaacaacagcaacacgtacaacagaccggacaacaagctcaaccacctcagggagtacaacaacaacaacctcagggagtgcagcaaccgcaggttgttcagcaacagaatcaacaaccacaggcaccacccgttcaccaaaatgatctgaataccaacgaagtacacccaccttcggctcaacaggtaccagcagcagctcaacaacccaacggaaatgttcaacattaagaactgaaatattaaattgtagactttcatcgtttgaatatgaataaagacttcctttacaagacatttatagacagtaatattttattgaaaagattttgtgatacaagtttatgttgtctctttttcagcaactagtcttagcgtactactatacaatttgaagaaaaattgtagcatttaatctgtttcgttttctcagtgtagtttttaactgttttatacctaaaaatattttgactaaataaatc

SEQ ID NO: 58 - DNA, 1179 bp, Diabrotica virgifera
  Annotation=Cxpwmw03
  SmartBlast Evalue=1E-130; Info=Cxpwmw03 n=1 Tax=Periplaneta americana RepID=Q2LIY7_PERAM
gggactgggtacaggatgaactttgtacttttataattttccttttacttcatgtagtaattcattcatataaatcatatatcaaaattataagtataggaagtcggtagtatcgaaaatatttaccaagatgttttcaaattatactagaactctaggaactcagctaagaagattccaaagcaccttggtaattgcagaacataataatgaagtcttgtcccctatcacacaaaatgctataactgctgcaaaaaagttaggtggtgaagtatcagttctagttgcagggacaaaatgtggaccagcttcatcagccctttcaaaagcaggtggtgtatccaaggttctggtagctgaaaatgaagcatttaaaggtttcactgctgaaaatttgactccattaatattaaatgcacaaaaacagtttaaatttacacatattattgctggtgcctcagcatttggaaaggctcttttgccccgagtagctgcgaagcttgatgtttctcccgtaacagatattattgctataaagtcccctgataccttcgttaggactatctatgctggtaatgcaattcagactttgcaagtcacagaccctattaaaatattaacgattagaggaactaactttgaagctgacccattggatggtggttctgcagccactgaaaatattccagcagatggttgtgccaatgatcttactacttttgttagccaggaattgagcaaatcagacaggcctgaactaacaagtgctaaagtagttgttagtggaggtcggggtttaaagtcaggagacaatttcaaacttctatatgatctagctgataagttaaatgctgcagttggtgcttcccgtgcagctgtagatgctggatatgtaccaaatgatatgcaagttggtcaaacaggaaaaattgttgcgcctgatctatatattgctgttggtatttctggagccatccaacatttggctggtatgaaagacagcaagactatagttgctatcaacaaggaccctgaagctccaattttccaagttgctgattatggactggttgccgacttatttaaagttgttcctgaattaactgagaaattataataaaattttgtaaatattttttgtgaaatgtccagaattagttaaaatatatattttattcc

SEQ ID NO: 59 - DNA, 986 bp, Diabrotica virgifera
  Annotation=Gerrochelatase, putative
  SmartBlast Evalue=1E-133; Info=Gerrochelatase, putative n=1 Tax= Pediculus humanus corporis RepID=E0VYP4_PEDHC
tatgggttgtaactaaatcacagagagcttctataaacaaaggatgatcatttggagctggtactcttcgaattatttctacatttaactccttagctaaatctttacaatactcgatatctaattcatgaagagtttcgatgtgttcattaacaaatgcaatgggaactacaacaaaagttttctttccttgttttacatatccttcgatagcttcatcagtcattggtcccagccaaggcaatggacccactttggattgccatactaactggtaacggtgagagaagtttaattcattcattacttggtgtacagtagcacccacttctgaagggtaagggtctccacgatttactgccttcaagggcaaagaatgtgcagaaaataaaataattgcttcatttcttttagcttcaggaatttgttgtaattctttcttaatattatccgcaaaacatttagctaatagggaatttataggccaccgatcaataactgacattgtcatgccctttgggagacccctattcttgaaatatctataaatttcattaaaactagaaccagatgtagcacagctgtattggggatattgtgaaaatatgattgcatgttctacaccgtccctttcaagttcctcaaaggcatcttttgtaaatggcgggacatatctaaaggcaacatagggcttatgaggagcagaatcggggcactgttgatcgagtttatcacataaaagtttaccctgtagttttgtccactttagaataggtgacccaccaccaatctcttgatacttcttttgaacttctggagttcttcgcttagctatccaaggtcccaaatagtcttgagctattggtaattgtatcatatctctatcagtcattattctgtgtaaataatcatgaacttggtttatagtttcaggacctcccatattaaccaaaacaataccagtctttggatttgatacattgtag

SEQ ID NO: 60 - DNA, 1557 bp, Diabrotica virgifera
  Annotation=D-3-phosphoglycerate dehydrogenase
  SmartBlast Evalue=1E-116; Info=D-3-phosphoglycerate dehydrogenase n=1 Tax=Glossina morsitans morsitans RepID=D3TRK9_ GLOMM
gccaaagtattcgaggactaacacttcaacaactaaaaactggattggttcttgtttctattgagtacgtagtatgtcattgttggttttatcatctaatctgtaaaacatgtaaatgctaagagtttggaaattttggtgatatccataaatttcataataattggtttcgataattcattatttgttatttgttaggccgaccctgaaaatagaaataaatatcattaagtcaccaaatcaagcaaacatcactgtatccaagtagtagcaaagtagattgggacagtggggagagttcatcggttaaacttgatatcaacagacaattgacattgaaattcaaacaaacaacactttcatcagcgcacaacgaagggaacgcgtaaagtgcgtacctacttcaaaagtattatcaagaaagttgtttctccaagttgaatcagtgcattgaatagtcgtctaaaatggatataaaaactgttttagtagcagatgcagtagatgctgcttgcgttgaacttttaaaaaaatactcaatacaagttgtttgtaaatataagttgcccaaagaacaattgatagccgaaatcgcaacgtatgatgctcttattgtccgatcagatactaaagtaactgcagaagttatacaagcaggtaaaaacttaaaggtgattggacgtgcaggagccggcgtagacaatattgatattcccgctgctacagctaaaaatattattgttcttaacacacctggtggcaatgccattagtgcttgcgagctcacgtgttccttaattacaacactggcaagaaatgtagttcctgcagctgcatctctaaaagctggtagatgggacagaaaactatattcgggacatgaactctatggtaaaactttgggaattttgggactgggaagaattggaaaagaagtcgccattagaatgcaagcttggggaatgacgacaatagggtacgatcccattgtaccagcatcagaagccaagaaatttaatgtggaggctttggaactggagcaaatttggcctcgagtagattatattacagttcacactcctcttataccagaaactagaaatttaatttgtgaagcagtactcaacaaatgtaagaaaggagtaaagatcgttaacgtagcaagaggaggtatcattaatgaatcagatcttctaaaggccctaaaatcaggacagtgtggaggagcggctttagatgtatttgaacaagaacctcctaaagatccagtcactttagacttgatccaacacgaaaaagttgtagctactcctcacttgggtgctagcactgatgaagctcaagttagagtagccgtagaaatttcagaacaaataattgcattaaccggaagaagtaaagaatatacatctacaccaggagtggtaaatagaagcgttctggtaaatttgtcaaagtgattttgaatatcatatgtacagtacgtaaaccatccactctgtatgcatatttttttctttactttgttaacatttaaaataaacatacgtttttttt

SEQ ID NO: 61 - DNA, 1412 bp, Diabrotica virgifera
  Annotation=Sphingosine-1-phosphate phosphatase 1
  SmartBlast Evalue=1E-110; Info=Sphingosine-1-phosphate phosphatase 1 n=1 Tax=Harpegnathos saltator RepID=E2C638_9HYME
cggaactgcaatctgcaatgcggatctgcagtatacataatacagtttacatgttttgttaaataaaaaaagcaacagtgatataaatccaagtacaataagaatatccgcaataaattcaaccagtgaaaatggagtacctcaagaaacctgaattggtagccaaagttcaaaaatatttcggtgttaatacaaaacatatccaaaaagataaagagtacacaatagagaataagttctggtattatttgtttgtttttggtacagctctaggtgatgagaccttctattctgcttttattccattctggttttggaacattgatggggcagttggaagaagagttgtcttggtttggacaattgtcatgtatataggtcaaggcatcaaagatataatccagtggcccagaccaggccctccagtagttaggcttcaaaataagtgggctttggagtatggcatgccttctacacatgccatggttggagtgtccataccattctcagttttgttgtacacaatgggccggtaccagtacaacgttcctttggggatgtgcattgcagttctttggtgcactttgataagcatcagcaggctctatttaggaatgcatacagttttggatgtcatagttggtttagcgttagccgtactcattatgtttcccattgttcctttggtagacttattcgataattatttacttacaagtcccacatctccgatattattactagtttcgtcgattttgttgatattctactatccaaacagtggcaaatggactccaaccaggggagacactacaatgatcctctccgtctgcgtcggaatccaaataggctcctggctgaacttccactccggcctgatgaccccatcagagctcacaccaccatacatcatcatgtggccctcctacaccatgttcggatgcctcctccttcgcaccttcatcggattcgtcactgtactactcacgaagaaagtcttcaccagcatcacctacaacttcctctgtgctatactcagacaagatgtcaataatctgaagaagtctgaaaatacactgcaaaacaagcacaagactttcgtcgagctgagctgcaagtacgtcttttgtgccatgatcggtttcaacgctgtctatgtgctgcctcagctgttttaggtttttgcgaatcgaaagaccttacgtttttcacagagatttgataatttactttttgtaaaggtaactatacatatatctagtcaaattacatctcagtttatgatcagggttgttaacaaatatttggagggatgaacgtcaaatgttgtaaataaaaagaacgaatccagttattgttacagttattaaaaaatgtctttaggccagttatattggtgtattttttatttg

SEQ ID NO: 62 - DNA, 1237 bp, Diabrotica virgifera
  Annotation=Delta-aminolevulinic acid dehydratase
  SmartBlast Evalue=1E-119; Info=Delta-aminolevulinic acid dehydratase n=2 Tax=Culicini RepID=B0WF62_CULQU
acaatttttattctctatatttccaaaaaaaattaatgctaaaataaacaagtgcatcgtcaatattttatatcatattttttgtcatataatgctatcaccattttgctttatttttaataacttctctctataatttgctttttaacgttgtccattccagtacttgtggggtaaaataagaaataatgacatcagcacctgctcttctgatggatcctaaaacttccattaaaataacttttaagtcacaatctcccctcgtagcagcatgatgaatcatggcatattctccagatacctgatatgcgaacatgggatactcaggatgtttgtccttgatctgtctcaatatatccatgtagctcatgacaggtttaaccatcaacatgtcagttccttcatttacgtctcgatctgctgctctcaaagctaagccagtgctctgaggaggcagctggtagcattttctgtccccaaaggctggtttcgatttagctgcatctctaaatggtccataaaaacctgatgcgaatttcgcagtataagataatactgctactctattacctaaaccattattaaccaactttgttttaatggctccaatccttccatccatcatatccgacggtgcaacaatatctgctcctgctttggcataagctagagctacatctgatattctttggatactagcagtattatttaaactaccatcattgttcagtattccacaatgtccatgggaactgtaagggcataaacaaacatcacaggctattgtcagattaggaaaccatttttttagtttaggaagtgccctgactactggattttgtgagctatctgcgtgggtagcaaaatcatccttggacaacttttctaccactccaaaaagtaacacagattgtagtccatttttaacaacatcttgtaaatgatcacgtaatttatttactccataccttgaaattccaggcatactactaatgggttgtacgacatcatcatcttccacaataaagactgggtacatcaaatttttcgctgtgatttcacattggatactctgccagtcccttaaagtttgattaaatataccactttgcagaatatctttattttttacctgaaaattaatttttgctgtcatgttttactaatccaaacgtcaaacttggaaatgattgataagcagataagcaccactgtagacgtctatgacctgttgtag

SEQ ID NO: 63 - DNA, 1452 bp, Diabrotica virgifera
  Annotation=Apyrase
  SmartBlast Evalue=1E-115; Info=Apyrase n=1 Tax=Aedes aegypti RepID=Q175I8_AEDAE
gattcgtgtgttgtgtgttccagttggattcctaggttaagatcgattaaaagagggcataacttttgaaattcaagtgtaaatatgttgtgaaacaacataaattcctctgtgagagactctgcctgaaatcaaccgaagatgtgtcattaaaagtattcgttaaaaaaagatgacgttggcgttagtctacaccagaaaaattacttacgtgtatatgcatagatgattaccagtgatgattccaccaaaggattggagaaaagctctaaaatcacaaccagcttatagaattgtaaataggacaatatgttgccagacgttctttgtgtattcagtgggactaacaggcataattttgttgtttttcttgtacacacattcttcaactggtaccagtagttcatattatagaagaagtaattataattatacctatccaataactaggcctataaagacgaaatccatgcacactttccgaataggtataatcgcagatttagatcaaagttcacatagtaaaaaagaaacagatacttggtattcctacttcaaaactggatatttgacgtacaatcctcaaacacatcacatagtagttaattgggatcaaaaagaagcagacatgctgaaaacgagttatgccctcaaaggtagaggattagagctgtcagaattggttacgttcgatggtaaattattaacatttgatgatagaactggcctagtgtttgaattagtgaataacaaaataattccttggttaattcttatggatggtaatggaaaaactcaaaagggtttcaaatcagaatgggctaccgttagggatgaagtgctttacgtagggtcaataggaaaagaatggacaagtgcagagggtgagtttgtaaataatgatccacaatatataaaaaccatcaccaaagaaggccatatcaaccatataaactgggttgaagaatataatagattaagaggtataatcggaataaagtggcctggttacatgatccatgaaagtggactgtggtcagctgtacataagagatggttttttctaccaagacggtgcagcaaagaaaggtataatgagagtttagatgaacatcgtggatgttcagtgcttattaccgctgacgcaaatgttaatgatgtgaatgtgatagaaattggtaatgccaaaccaactagaggtttttcaagctttaaatttgttcccacatcgaatgaccaagtgatcgtagctttaagaactgaagagttaaatggaaacactgcaacatacataacagcattcacgatcgatggtcacatactgctggaagatgaacacattgctgatgataaatatgaaggttttgagttcatttagtatttctctagtcaattgttttatatttaatatgttgtaaatttcattgtaaaataaattatttaaaatcatag

SEQ ID NO: 64 - DNA, 1376 bp, Diabrotica virgifera
  Annotation=NADH dehydrogenase (Ubiquinone) 1 alpha subcomplex, 10
  SmartBlast Evalue=1E-139; Info=NADH dehydrogenase (Ubiquinone) 1 alpha subcomplex, 10 n=1 Tax=Tribolium castaneum RepID=D1ZZE8_ TRICA
ggaaaggggttaagtaaagttacataaaatagagaaaaggcagaggtttaaaaagtatatgtgtttttcttaataccctcagtatgtctacctttgtaagagtcggctttggcagagttaaccaaggcttatgtaatgtgttaaacaaaacccaaaatgtaactttaattcgagcaatttctagtaagaatacaagaagtgctgaagagcgatcacccaaaccagccccatggccgtatcaagagaaaggattcaatttgtttaattatttgtatgataagacaactgcgagattagatgaaaattctaagataatagttgttgagggcccaccagccgcaggcaaatcaaagcttgcaaagcaattagcagcagaatttgaaatgttatatttacctgaggctaatttagacatggaatatattaacagctatggctttgatttaagaaagcttgattctgagataccagaaagctgtaggagttgggatgttatggatttcttgaagaatcctaaacataggcatactcttaggttccagatgcaacagtatcaagtaaaactttcccagtatgttgacgcattggcacatgtattgagtactggccagggagtcatactggacagatgcgtctattcagactttgtatttactgaggccatgtttagtcaaaattatttacacaaacttgctcgtaaaacttactacgaactccgtgataatacgattggtgaactgttaagaccgcatttagttatttacttggatacgcctgtacctaaagttatagagaacattaagaaacgcgccatcagttatgaaaaggattctacagtgttgactcctcaatatttgggagttattgagaaacaatacaaacaaaattacttgaaggatatcagtaaacatgccgaattattggtgtatgattggtctgaggaaggcgacgtagaaattgttgttgaagatattgaaagaattgatttcaacagatatgatgagcaggactcatatatgaaggattgggtgtacagattagaggaagaatgggcagtcttacgacacaaatacgccgataaaaaagatccagaaattatggcttattgcaatattcctgcatataatgttcccgaactggttatcgaggctgaggacgctgataaataccataaggctatggctgaggcgcctggacaagagtacgaaattggatacaatgcggctttaggagacaccggtttgttgtttaaaatgaggagtcctcaccgtgaaactttaccattaagagaaagaaggaccgtctaaacagatgttgcttgtattcattgtatatacaaaatatagataatttaaaataaaattatttacaaaagt

SEQ ID NO: 65 - DNA, 2345 bp, Diabrotica virgifera
  Annotation=CDK5 and ABL1 enzyme substrate 1
  SmartBlast Evalue=1E-101; Info=CDK5 and ABL1 enzyme substrate 1 n=1 Tax=Camponotus floridanus RepID=E2ALX6_9HYME
cgcatcgaaaaatgcataaacatgttaaaatcagtatattaagggccagattttcttatttcggggtatttggggtcactgaacacgaatttgcaatcagaaccgacctccgaagcacctgggtgcccagggttactgctaaggtacgtcatctagagtttcgagggtttgtttttggcacttaattgatgcaaacagattactcgagattactgatattgtggagcagcaatgacagaacaattacatatcatttaatttctatccattaaatagatcggtgaaggtcgttatatcggatcttatacttatacgaaatactgagaaatgcgattctcgatatgattaccggtactcaaatacaaaagtaatcaaagtaattaaagtaatcaaagtaacgaatactttaaatgattactttatacaaaactactttatacaacatcactagttagttacataattgatacttgagaaagatgatgtaatgaataaataagttcacacgtttccagctatacaagaaccgaacatatcagtagacaaataacatttttgcaactttgaagacatatactatgattcatataaaagcctttgataatgaggatacacttctacgtaggtatatgtagtccaaattccagagccactagaacagcaaattcagtagccatcaattcttttctgttcaatctgaaggttgcctccgtcttttcgatcaacaacttgagagcgtcacccttaacgtcgtttagtttggctgagaggatcaagctggcaccagcgcataatttccggttttgtttatggattagtccgcgtaagataagtttctcgaagtagacgtaagcttgggcgacggttagaagatctatgttgctttcttgtttggctattttgcgcatttcgcgctttaagcttctcaatttacttaacgtcaaatcgatatgtggaaatttatctttgaacttctcgttaatctctcgtttcaaatcagacggtttgacgtagtcaatgacagatgtgacgtaggaagtaaacgttagaacagtcctgtgtttcccgacaataagttccgggtcgtctagtaggtctggatgataaataaatccttttattaatgtttcttctttaagctcagatgcgattgcattagatgtatgggaagctatcctttggcctggcgtgtcgtatgacaaacatcttgaaacaaaatgtcgtgcgtttcgtttaagaggatcgagcgactgatccgtgggatcgtcaatggtgtttcttttcaaaaccacatcctttggatacttcgaaggttccagtaaatatccataagattcttcttgctgaccatctctagctcttgcgatgccaagtgaatcatatggatcaaaaccatccccagaagtagacaaaggtcggttgccagatgctgttctcttgcgttgtgcttctctcgtcagatttgccctgtaatttctcttatatggaatataagaacacaccatgaagggtgaatgcttggcagttacaaaaacaatcctctctccagaaaacttgtgatcccttgttggttttatgattgttattttctggcgagatttgtcccctactaatttatttctgaaagtaacagagcctaaactctcacagctgctatctttttcctttcttctttctgcctcactgcatatagacacttgatgtggaatcttcttaagaatctttggaattattttcccatctctgtcaactacatccgagttgtccctagtatgtttcctaaatgcgttatcttctaaagtacccttaatgggtgcaataatactttcagattctgagtcactattgctaggcctatatttcttaatttgcttcttatggagtacaggtgtcaacttttcattcagattttgctgtgatttaagtaaatatgaagtttcatctatgtcttcagcttcttccggcaaaatgtcctctgtacaaagaaatggggctcgtgttgtggccccatttttgggaagaattgctaacttagtgtctttgtaactgccatcaagagtaatattggtcaaaaatgagagggcggcgatccttcgacgagaattggttcgttttaatgaatttgccatttatagtatattaaaagttatgtcacagataaacatttttggttatagttcttttttcactcatttcactagcacagtttataaaaacaattaaaacacacggcgaaacattactccgtaatgctagacacatctttatctctttagtgtcacaaataaatatataatttaagattttaaacttattatgtaaaaagtacagtccaaataaatgta

SEQ ID NO: 66 - DNA, 1484 bp, Diabrotica virgifera
  Annotation=THO complex subunit 5-like protein
  SmartBlast Evalue=6E-80; Info=THO complex subunit 5-like protein n=1 Tax=Harpegnathos saltator RepID=E2BKD1_9HYME
gcgagattccaatcttttaaatattattttcattataatttctacattagttctgcctaattcatccgaatccatttttttattaagaaaatctcttccgcatactctttgagcccaatggtatgcgtatccgatctgtggcactaacgattgaaaagaagtaagtccgatcttcttaatctgaaatttcgttattggatttggactttctaggccattatcatcttctaccaactcactcagaaggttctctccggttaacacttccctagctgagttgccagttattttacatgctgagcagttcgtgctggacatgactgtaatgatttttaattttattaggtaggaaaacttgatagtcagcaaaggaccatcctttaactttgccactatttgaacttgtaagggatgtgattctaaaagcttttttcttttttcctccatcggatctatctgttgcaccgacctcctgtgacgtcgttttttaatttcaacgacttcctctatttctgcggcatcctgttcagtctctggggtgtcagactcatcgtcattagcgaatcccattccaatttttaaatctttccatcggttagcttcctcttcgtcgccgatgatttccacatcgagattaatatcgtaaacgactttataagagacgacgttgacatagaatatgtataacgggtctggtagaagataagctagtttatgttcaaccctcaggccgctcggagacatttccaaatgatcttgaagcggcttggtggcgttgattacattgacaagtagcggtgtgagggcggttagcttgtcttttcttaataacagatcttcgctcagtttcttcttctgttccaaaaaagctttacacaattgtgccaaattcttacgttgggttaattcccattccaatctagcgagacgtaaactgtgctgttgttctctgtcatccggatcatatgaagaaaatttcgaggacaatgattctggtgcttctctcataaattcttcaaacggtacaagttctatgtcttcatctttagatctaaaagctaaacacttgttagtttctgtcaccaaatggtgacgttcatacaccaagttctgatacgtcagcttgatgctgtcacatttctgtttttctgtagttagggtttcctttccatgcacatgcctaatcttgtcagttctgttcagttttttcaccatacacattttgacaactatttctgcgtgaatatcttttatttcattagatttcttatctttctgtcttaaactcattgctttggcaagaagatttctgatatcttcacaaagctcaaaataaacatttgcttctaaagatgcttgactatttaatgattctttttcttcaaaatttgccactttcttatatatatcattatcgccttcatgttctgggttggaaactttgaagaaaaagaatcattaaacatttgcttctaaagatgctt

SEQ ID NO: 67 - DNA, 1504 bp, Diabrotica virgifera
  Annotation=WD repeat-containing protein 75
  SmartBlast Evalue=1E-107; Info=WD repeat-containing protein 75 n=1 Tax=Camponotus floridanus RepID=E2AYB6_9HYME
cacgctcgtatggatttgaatttttttaagatttcctcatttacgtaaattggctgactggaacttggggagaaaacatacactttattgtcttttgtaattacggccatatttgtggacaaagtatccgcaatcaagaatgatacagaaatcggtactgtccatgtcatagataacgttaggatattccaaacgctaagttgatttttactagccgctacaagtagatggcattggttaccgtagccaaactgtatgtactttaattgtttcttatgaagaggatggagtagagaacatttaagcaaacatgtatcagaagtccaaactgtcagtatttctccgaatcctgttgcaaatagagacccatctattgaaaatgataaagcattgcaaggcaaatttcgataaaagccaactccaaagcactgccaggatagttgagtacctgtgactacttcaatttcggacaattgccatattttaaattttttgtcgtctccaacggttacgcactgaagtctttcatctttactacacggttgaaacagcatactattaatgctatcttcatgcggatattcgatggaggtatttaggtgaaattgttgtttagattcatcaaacttccaaaactttaatcgtatttcataattatattccctatcttttctttcttccacagtagcaaaccataatccacttttacttattgcaacttttgttacttcagtattgatcattatgttttctctctcattcgttattctattttgagcagttatatcaacactgtaaagaagagacatgtcatctggggaataaaactggatatgtccttgattcccattcattattagagctctggacctactatcatgaacaattccactatcaaaatgctgtgctagcaccaaattttgaatcaaactgatttggtagagtgtattatcaaaaattcgaatagcattatcatttgttgaaactgcaatatgtaagttgttattggcaaccacaacattgcagatctctccgggtatacggggcacaaactttttttcatttatattatcatactgccattttactagtacacattcacctccaccactataaaagtaactacctgatgtggagaagcgtactgtttgaacaggtaaattgtgccagtgaaaaacggtttgtttagctttagctgcaaatatatcatgccaaccaaccacacgaccagttgagtcaccagtgattacaatttcttctgtagaatgaactgctacgcatgtaaaatttcttgtattactcgtaaagcatctcgaatattccttaaagttattcaacttattaaaaacactttattatcatgaacaacagcaaagaaatgtaagttgttaacatcaataaatatggaagcttacagtctagtactatactgtattccttagacattttcgttttgcattgtagtgagcaaaacgaattccatttttatgtttataagaatata

SEQ ID NO: 68 - DNA, 1072 bp, Diabrotica virgifera
  Annotation=Oligopeptidase
  SmartBlast Evalue=1E-100; Info=Oligopeptidase n=1 Tax=Aedes aegypti RepID=Q17PU3_AEDAE
atcaacacttccacctaaagctaaaaacaaatttcgaaatcttctacccacttcttttgtttgttcttcatcactcctaacttcataaaatgcactataaatatcagcggctatcattctcgaccaaatatgatagtaatatgctgcagcccattcttcactgaatatctgtgtaaacgaacatagatggacatctattttgtgcaaagtaaaattcctatgttctggccacaacattttgacaatatccagccagaactcttttgaggtatgtaattctaaatctaaggaagctaagtataggtctctgcataggtctaatcctgccatatgtttatctgtatgaactaacgatttgtacatatcttctggtagtttctcacctgtttcacaatgggaggttatactgtctattacagatttattgtttagccaatgacttaatacatatccacatacttcaactgcatcccactcaacatttgataaacctgcgacctcagagtagtttgtccgtgtgagtagatgttgtagattattaccgaatttatgaaacagtgacttaacttctttaaaattcaggaatgaatccttacttcctgtacaagggtcaaaattaaatataagagaagctaatggtatcctatcagtaagagtgctcttattttggatagcaaccatccaaccagtattctcgatttttagtttctgttgatctctcgcgtaaggatcaaaataaaaacctgcaactggagcactactgtgtttttcaaatatatcatagaactttacatctttatgccatacagtagctccacttctttctttaatgtgaacatcaaatagtttttcacacaatttaaacaagccacttaaaacagtctttaacggaaaatattgtttaaaatcattttcactatacgcatataaagattgttgttgcttccttttccaataaggcacatcccacaattcaagtttatcatcctcaaatccattctctactgcaaaatcgtacaactgtttaacttctgcatcttgggcactttttgcaacttccaataagctcagt

SEQ ID NO: 69 - DNA, 1268 bp, Diabrotica virgifera
  Annotation=Sodium/bile acid cotransporter 7
  SmartBlast Evalue=2E-84; Info=Sodium/bile acid cotransporter 7 n=14 Tax=Mammalia RepID=NTCP7_HUMAN
aataatttcgacagtcgccatattgaaagcgacttgtttttggtcgaaatttgatttagaatcagggcccagggcccgtcaggctgtcagacaaactggacaaaacacaaaaatggataatccatttgaatgaaaaatgtaatttgtattaaaataataaattatgaaatatcgtatcacaccgttgcgatttctacaaaagaattggcttttagtaggtattttgtgctgtatttttgtagccggtatttacccaaaattaggatctaaacaagggcctttacgaacggagtacacagtaaaatatggtgcagtattcattatatttttagtaagtggtctgtctttgaaaacagatagcatttttaaaacattccaacaatacaagttacattgctttattcaatgtttcacatttatttttatacccctttttggggtagtattaatccagtttttatatatttttggagttcatccatgggtattaaaaggaatcactacagtagcaagtatgccccctcctgtttctagtgccgtaattttgaccagggctgcacaagggaatgaaagtgcagcaatatttaattctattttgggcagttttataggtattatagtaactcctattttattgcttcttcagttgggttcaacaacaatagttccccttttagatactgtatttcagcttgcagtaacagtgcttttacctttgacgattggtcaagttttaaagaaacacactaaattgaaaatccaaacgttgcctttgaatacaatcagccagtgtgctctattgttcgttatttatactacattttgtgatacattcctagtaccagaaacgggactttccgctttggacgtactttttacagtattttcagttctcttaatgcaactgagtttgatgatgatcagctttcatttggcaaacatgtttataaaatatttcaatccgcaagatattatagctataatattttgttcgacgcacaaatctttaacgctaggcattcctattcttcgaataatgtttcacggatactcacacctaagtcaaataagcttaccacttttggtgtaccatccaactcagataattttgggtggcttagtcgttcctcagttgaaagattggatgcattcgcagagagcaaaacgaccaccagtgtagatgtacatattgattcgtagagagcgctaatagattatgaaacaaattcattgcaaattcaaatattttgcaaacaatttattttaga

SEQ ID NO: 70 - DNA, 795 bp, Diabrotica virgifera
  Annotation=DCN1-like protein 1 (Fragment)
  SmartBlast Evalue=1E-110; Info=DCN1-like protein 1 (Fragment) n= 2 Tax=Apocrita RepID=E2BR92_9HYME
gctccttcttcgtcgtagttgctcatatcgtcagcgatctgctgagcaaaatctaatagaagattccaagtatccttaggaatagatcgtttatggttttcttgcaaaaatgtacaccataaattcaaaaatttgaactttcccttaagtacgatattccagtaagcaatcgccatatcaagatctaatcctttctgtcctggatttttggcataattgaaggtaaaatgataaaagtccttaaacttataattatcccttaattcattttctaaactgggcaatcgcgccttcaatttatctatattatcacaacctaattctgtcattccgtttataaactcatccctggtgaactcgcactgagtcgctgctttgaacttccaagctatgatgaggacgagctttgattcgggcgggagaccaagatcatctaagaacttcatgataccatctactgtgattttatctggttcagtgggatctttgtatctgttatataaagattctagtttctttttgtctacactcctcggctctttgtaatatgcatcaggattctggaagtaattatcactagctagatctagtttccaatcattctgagtaaggcaatatatggctgtgttctcaccagtttgagtgaaagatataaatttttttactttttctctctgtgacgattttagtttgtgcatcgtgaaaagtagaggatttaataccaaactattaacaaaaagaaaccatttgaagataattttttttatttttgcagaattatgaaaaataacctca

SEQ ID NO: 71 - DNA, 748 bp, Diabrotica virgifera
  Annotation=Zinc finger protein 330 homolog
  SmartBlast Evalue=1E-122; Info=Zinc finger protein 330 homolog n=8 Tax=Sophophora RepID=ZN330_DROME
cggaaggttttggtccttgacatttaggtcacttattaaaaatttattaaataattttaataaaccctcaagatgcccaagaaaaaaacaggtcagagaaaaaaagctgaaaaacagaagctaaggcaaaaagaaataagaactgccaaagaaaaagttcctttagctgaccatccttgcaatatttgcatggaatgtgaaaagtgccatcgaaagcagaaaagtcgtgcattttgttatttttgtcaaaatgttcaaagattaccagtttgtgctcagtgtggcaaaatgaaatgtatgataaaaactggagattgtgtaatcaaacatcctggagtatatactactggaatgaatatggtgggtgccatatgtgatttctgcgaagcttgggtttgccatggtagaaaatgtcttcaaactcatgcttgcacctgtccattgcaggaagcaatttgtatagaatgtgaacgtggagtttgggatcatgggggaaggatctttaaatgttcattttgtactaattttctatgtgaagatgaccaatttgaacaccaagcctcttgtcaagttttggagtcagaaaattacaaatgccaatcttgcaacaaacttggacaatattcttgtcttagatgtaagacttgctattgcgaagatcatgttcgtaggaaaggatttaaatatgagaagaataaagcaataccatgtcccaaatgtggctttgaaacatcccaaactaaggatc

SEQ ID NO: 72 - DNA, 1346 bp, Diabrotica virgifera
  Annotation=Microfibrillar-associated protein
  SmartBlast Evalue=3E-96; Info=Microfibrillar-associated protein 1 n=2 Tax=Formicidae RepID=E2AVZ7_9HYME
ctttgactgtttactgttttatctttgacaattattaattgaaatccaaaaaatattggtttgtatgtcctaatttttaatagtttattaaaatatttcctttatttgcaatagtacatcttccaaaatgatgaacccacaatcaacgtacgcaattcaaagtactgctggagcagttcctatcagaaatgaaaaaggtgaactgtctatgcaaaaggtgaaagttcacagatatatctctggaaagaggccagactatgctcaagaagcacattcagacagtgattcagctgaggaagactttttggagaaaagaactcagttagttacagttccttctccagaacctataaggaccgaagaagatgatttgaatgatccacgtttaagaagattaaagattgctgagaccaatacagaagttagacctgaaaggcgaagacatgttttggagccagaagtcttggaatcatctgaggaggaagaagaagaaattcacttggctgaacataaacacacacttgaagctgctcctgatgatgatgaatctgaggttgaactcagtgattctgaaattgagaaaaggagagagtctttgaaaaagaaaatgttaactaaacaagaagatgagtttatgctgaaagaagaagaaaaagtggactcttcatcagatgaagaatcttccgaatatgaagaatattctgagtcagaagaggaaacaggtcccaggttaaaaccagtctttgtcagaaaaaaagaaagggtaaccataatagaaaaggaaaaggaggctcaaaggcaaaagaaagtggaagaagacgcgcaacgtaacgcagaagaacgaagaagacaaaccctcaaaatggtagaagatactatccgcaaagaacaacaaaaggataagacaacaaatgaaccaagtattgacgatgtttgtacagatgatgaaaatgacgaagtagagtatgaagcttggaagttgagagaactgaaaagaattaaaagagatagagaagaaagagaagcaatagaaaaggaaaaactggagatcgataaattaagaaaccttacagaggaggaaagaaggttacagttgagattagtacctaagaatgttacgaataaagctgtcaaaggaaaatataagttcttgcagaagtactatcatagaggtgcgttctatctagacaaggaagatgatgtgtacaaaagagactttgctcaggcaacgctggaggatcactttgataagactattcttcccaaggttatgcaagtcaagaacttcggtaggtctggcaggacaaaatatactcatttggttgatcaagatacaactaaatttg

SEQ ID NO: 73 - DNA, 854 bp, Diabrotica virgifera
  Annotation=Proliferating cell nuclear antigen
  SmartBlast Evalue=1E-119; Info=Proliferating cell nuclear antigen n=5 Tax=Culicidae RepID=B0WPF0_CULQU
catcttcttcaattttaggtgctaagtagtacctcaaatggcccaaatcaggtatttgatattcaactactaaaggtacattgtcagacatcgatagctgcacaacgttagtaagaggtgtggctttggtgaaggaattcaaatactgacaagcgaaagtaagagtaactggttcttgcatttctatgcttacagattcctcttccttttcgaaattacttgtctgggcaattttgatgttagcactgccaatatctccagaagttgagaacctaacaccctcttttgtgcatgagattacgatagattctccaaactgtgaaagatctttgactattcttgcgaattcagctgcaggcatcctgatgacacaagagaaatctgtttctgggatacccaaatgctcctggtccaaattcatcagtttcatttcgtaatctgagatcttgtcctgctttttggcttcaaacataaacgttactatgtcggcatcatcttgagctttgattgttactgtgtcatcattactggagcatttgaagatctttgacatgcttcccaagttcatgcccattgtaaggtttctatcacatctgtatttgtcgaatccatctgatttcagcgttagggagactaaggaaacgtgagagttatccatagcctggagttggatcccagattcggaacaatcgaaggatgcttcatttagaagatctttgattgcgtctaatacttttttgaaggtggcactttgaactaaacgtgcttcaaacattttggatttatttgtacttaataaacagttaaaataattgaaaaatacacaacacgatgacaaaggactatggccggta

SEQ ID NO: 74 - DNA, 1628 bp, Diabrotica virgifera
  Annotation=Solute carrier family 2, facilitated glucose transporter member 6
  SmartBlast Evalue=2E-84; Info=Solute carrier family 2, facilitated glucose transporter member 6 n=1 Tax=Harpegnathos saltator RepID=E2BQ52_9HYME
tattaactatgtttctacagctacactgacagaatctgatttatttacctcttcagacgaattatcaaaacctgtgttatcgacaccctcgatatcatcaactgtacatacttttttgtttcccctaaaatgagcttcgatttcttccagcgtcttgtttttagtttctgttagtatcgtctttgagtaaacggcagctaaaattgaagctactacaaatactattaaagttccgctaaagtttaaagcgtcgttcatatttatataaatctttgcacaaataaatatcaatagttgcgccaagcttactactatcccagacattatgggtctgactttcaaggggaacatttctcctaccatgacccatggaacgggaagcatgccaaccatactgaatgccacgttcaacatgacaccaattagtggcaagtagctaacaacttttctttgtctgggtatatttcataatattttacgtatatcgcaactactgacatggtaagggccataccaatactcgacatagtacataatgtctttctgccatagatatttataagataagctatgacaacagacatagaaaatcttattgctcccacaataatagaagctacataatcatttaaaggtacatgagtttctttaaagaaattaacggcatacattaacaaagtgtaaatgccagaaaattcttgcagcataaagagaccaactaaaattaaaaacggttttacagtctgtggaccgaagtacatttctttaaaagtcatattttgactgttgctttccttttgattttcgtggaatctgtcgatttcttgttgagctacagcattgtttcctctgaaccaaagcaacgtgttgaatgcatctgatgttcggtcgtgtttcaacaaataggatgggctctctggtacgagttggattactacagcagagaaaagaccaaaagctatgctaatgtaggctactgttgcataattcatgatataaccgagagtgtatgtaagtaggattccaaaggaggcgcatattggacccagagtttgcataaatcctctattttcggatgtggaaatttctcctacgtaggtatagcaagctggagacattcctgctgctattcctgtaatcagtcttccggcatacagccagttcacattctgagctaatccaaagcacatccatcccagaatcaacggtagagccgtcacctgaatggctcttcttcttcccatatattcagccaatactccagacaaaatggaaccaattggatttgttattgtacccaaactagcaatccatgatgtttcgtcgggactcaaatctttgtacttttcagactctttgagctgtggtagcagaattgcactatatccttggcaaattcctattgatattgaggttgaatgtgcacaaattgcagccagagcaatttttccaccgccatattcccaaaatttagctaatggtttcagcatatttcttatatagataacaaataaacaaaatataaaatactggtatcaaaactttggtacgaatcacgaaaaatttcccaaaaatttgaaaaaaaaattcaaatttttaagttgcacttcacataacacaaacgccgg

SEQ ID NO: 75 - DNA, 1176 bp, Diabrotica virgifera
  Annotation=Prolyl 3-hydroxylase 2
  SmartBlast Evalue=4E-90; Info=Prolyl 3-hydroxylase 2 n=1 Tax= Harpegnathos saltator RepID=E2C5A8_9HYME
cgtaaatctgtctctgcatgtattgggtagcttcccttcttggttggaagtatgtgatgtccacctttggttgtttggagtaatatctcatgttatccaacatagtctcatcatctggatagaacaacaggtaacttgctaccgcttggcatgcggctttgagattgcccaatttataataagcatattgcagatagtgataatggctgggtaataaatcatcatgaatttctccgttcaatgagcttaatttctttctacatttttgtttgcatcttaaagctactgtgaaatgatttgatatagatggtataaaatctggataccagccgtgatcgaatggtccctcacactgagctctacattcttcttctgcttggagataatgcaccaaactctcctccatattaaacacaacaaattgccattctttcttctcatacgcatcagctccatgagcatataggtaaacataatctttggcttcgtagtttacaatatcttttttttcaacgttgtggtcaagatagtgcttcaagttggtcgacatcaccttgttatccggatgtgctaccagaaacgtgaaagcagctgatgctgccttttccaattgctttgtctggaagtaacaaatatgtaaatattcataaggccgctggtcttcaaacaaattcccggattccatattaacattatggttttccagaatctctggactaccattttggcactcaataatacacaaagtttgtttgatagcccgttcaaaaaacagcaggttttctatgtccactgggtaaagcggttccgaatattcggcatcacttttacattttaaccgacaattctgcacttttttccgatatttccgatatttttctagcgctttttcaaaattaactacacaaccctcccatctgttttccaagtaagcttctaggcccttttcgtacaactgaacacacgtttgggtatcatttgtttcgtttgttcgaacatgtgtcaataaaaatacgtttaaaatgaagactgttattgcgcacgtgttaatcaacatagttaagtaagtagactgagtgtagactatagactcaaactaagtgaccggtgaccgtgcgtgtacaaaattgaggctgagttttacatgacttcgctaaaccacagccttaacacaga

SEQ ID NO: 76 - DNA, 1089 bp, Diabrotica virgifera
  Annotation=60S ribosomal protein L10, mitochondrial
  SmartBlast Evalue=1E-109; Info=60S ribosomal protein L10, mitochondrial n=1 Tax=Aedes aegypti RepID=Q17FD8_AEDAE
cgtttaacaatttatttagaaactacgaatattagacactgtaataagtcagaacaattatatgttacagtatagatttttaacatggttttggtacaatatattttatatagaattctatccagccaagacgttatgctgcctctgtaccattatccactatcctacgaagcataatattccttcagctcttcttccgcaggtttaagtatagtcttatccgtcaaattgaccacccatccgggatgtagaccatagaatatctgcctaggatctttcctttccattaacatctcgtatgcaggatcttcttctatttttggtaacctgtaaccatatttctgggctaggactagacgctcttgggatatcttctcgggatctgccaaatatcccctctgtgcaggatctgagtagtgttctatggcgtctgggggaggcatcattctgcggggtattggaatacctctttcaaaaaacttcttgctgttaaccatagcctgcagactgtgaggatcgtagtaagcggaagtgataacaccaccttttctctcgattgctgctataatatgttccgtacaccactggacttcgaggttgattttggcatcgaatatatctgcaccttcatctatcaattgtactccaaaatgatgttgatctgggtagattttgaacaagcctgtgtttaagattgctactaaatcgatgggctttgtggtgtctatgcgattggtgtctattagtttttggagatccaacattgataaaggtggatactggcgttttaaatggtgtcctctgtaatatggttcccatggaaaacgcagataaaatggattatttcctgtctcataaccaagtcgtgtatagttttgcctcgccttcgatcctttgttaccatgcccgtggtaatctccaccgtgttgagccctaccccttctcgtacacttgcgagctccaggattatctctaatattcgcaatgcatactctaggtaaaaatctaagaagattgagagctctttcagttgtattattactcatatctgaagaaaaaaaaattaataattctgtatttctgttttaa

SEQ ID NO: 77 - DNA, 936 bp, Diabrotica virgifera
  Annotation=General transcription factor IIF subunit 2
  SmartBlast Evalue=1E-113; Info=General transcription factor IIF subunit 2 n=2 Tax=Aculeata RepID=E2BPI0_9HYME
tgcaaaacatttttataaatgcactaatacaaatgcagatctagtctttgtgtaatagtgtaattatttaacggtatgtcttcaactagtgtaaataaaatgtctaaagatactcatattgaccgagatttggatttatcaaatgccaacagaggtgtttggctggttaaagttccaaaatatgtttctgaacgatgggaaaaagcttctggagatatggaagtgggtaaactaaaaattagcaaacctgttggacaaaaggctcaagtttcgcttacattatcttcagcaattcttaatttgaatgagcctggacaagaaagtattccaaaggatcatagattagatgtatccacagttactcaacaaactttgggtgtcttttcacatgttacaccaactaatattgattctgtggtacctgaaactgaaaagctgcacatggaaggcaaaatagtgcaaaaattggaatgcaggccatatgcagataattgttacatgaagttgaaattagaatctattaggaaagcttctctaccagttcgccaagtgaagcagttagacagggttgtacaaacatacaagccagtatctgatcataaaaataatattgagtacatggagagaaagaaagctgaaggtaaaaaggctcgtgatgacaaagaagctgttttggacatgttgtttgcagctttcgaaaagcaccaatattataacataaaggatttagtaaaaattactaagcagcccatcacgtatttaaaagagattttaaaagaagtctgcaactataatttaaagaatcctcataagaacatgtgggaacttaaacctgagtataggcattacaagcaagatactgaagctgaagcgaagaaggaggagtctgatgatgattgaaattatgattatttatttttaaattgtttaatatct

SEQ ID NO: 78 - DNA, 981 bp, Diabrotica virgifera
  Annotation=Electron transfer flavoprotein subunit beta
  SmartBlast Evalue=1E-118; Info=Electron transfer flavoprotein subunit beta n=2 Tax=Formicidae RepID=E2AIR9_9HYME
aaaagggggcaagttggtggtaaggtttaaagtccaaacttcatttattttatttatacagtaattgtagtcctattatttatttaagttgttaaaatggctagagttttagttggagtaaaaagagtaatcgactatgccgtaaagattcgcgttaagcccgataaaacaggtgtcgtaaccgatggaatcaaacattctatgaatccctttgatgaaattgcagtagaagaagccgttcgtttaaaggaaaaaaaagttgcttcagaaatcattgctgtatcatgtggaccagcacaatcccaagaagttctcaggactgcgttggctatgggggttgataaaggaattcatgttgaaatttcaggacctgaatacgaaactctgcaaccaatacatgtgtcaaaaattttagccaagattgctcagaatgaaaaggctgatctagtgattgtgggaaaacaggctattgatgatgattgtaatcagacagctcaaatgacagcagcagttttagactggcctcaagcaacatttacgtcaaaattggaaaaaggggacaaagatctcacagttacaagagaaattgatggaggtttggaaaccattaaatgcaaaattccagctgtaataagtgcagatttacgtctaaatgagccaagatatgccactttacctaacattatgaaagcaaaaaagaaaccaattcaaaaactaactcccaaagatttaggagttgatgtatctccaagaatcaaagttataagtgtagaagatcctccagttcgtcaagcgggagccattcttccagatgtagatgcattagttggtaaattaaaggaaggaggacatatatgatctggaaaggacacataatttttactcaataaagaataaaaaagtacaactgaaagagcctacacatattttctactccatattttgttatagccgttgttgtaaataaataatagatttgct

SEQ ID NO: 79 - DNA, 977 bp, Diabrotica virgifera
  Annotation=Zinc finger protein-like 1
  SmartBlast Evalue=7E-78; Info=Zinc finger protein-like 1 n=1 Tax=Camponotus floridanus RepID=E2AIZ8_9HYME
aaatgtttaataacgctattcacaagttagctgttttgactaattcattatgcctcacgtcaaaattcggatcatcatctatggaatatctgctgagtttagacataacaaagaagaacattacaataataaatataaccagtgctcccagcatgcaatatcgccggcaaactgattttcttcctctagctcttagcggtgctccgaaagttatcttgaaccaatttccgaataattcagaaataggttttcttttatacttattatcgtcatgatcaaaaacgtcaggtttgatatctctaatgtcctgaaatatccgccgatttgaagaatgctgaaaactatctgctctgttgaaagcaccaatatcttcatccacagagaccaccgaatgggcggggctcggagttatcctaggaggcatgctcatattatggtttattgtgctttttatttcacgttcctcagacaacaatggcagtcccaggccagccctagcccagttaactccagccagtttttcttttagcacatctgctacaggacttattaaattagatggcggaaacaatggacttttgcaggatggacaggtgtaacctctgggtgcagtggtaggaggtagctgtcttgaaaagtgatccaaacatgaccaatgaaacacatgatagcaggttaatcggatacagtcttgactacttaattctttactacacaattcgcatatcgagttataatcactgtcttgtaaccattgaaggtatgactgaactatacaaattgtgtgatttgttaccatacagttttcgcaaacacagactctatgctcgaagcagaattgattcgttactcgtcgtttcggacatttgcacagccccattttagctctattttatatatgaaaattatttaggtagaatcacatcaatattttaaaatatgtgagactacaaaattgttcgatccagggccggcca

SEQ ID NO: 80 - DNA, 743 bp, Diabrotica virgifera
  Annotation=COMPASS component SWD2, putative
  SmartBlast Evalue=1E-118; Info=COMPASS component SWD2, putative n=5 Tax=Neoptera RepID=E0VJS5_PEDHC
ttctttttaaatagtttgggattaaattgtacccaaaagaagttccacaaaaacggctgcacatatgaagatgaaattggtagaccaagtggtgcggagtttccgcgttgcaaaggtttttcgagaaaatacagacaaaataaacagcatcgatttctcgccgaccggagagactctgatctcatgcagtgaggacgaccaaattgttatatacgactgcgagaaaggaacccaaatacgaactgttaacagcaagaaatacggagtagatcttatacattttacccacgcaaaaaacactgccattcatagttcaactaaagtcgatgacacgattcgatatctatccctacacgacaataaatatattaggtattttccggggcacaccaaaaaagtcgtatcactttgtttatctcctgtagaggatacatttttgtctggatcattggataaaacgctcagattgtgggacttgagatcagcaaattgccaaggtttaatgcatttatcaggaagaccagttgccgcatatgatccagagggactgatttttgctgcaggtgttaattcagaaagtataaaactatatgacctgagatcattcgataagggcccctttgtaacattcaaactgacacaagaaaaagaagctgactggacaggattgaaattctcccgagatggaaaaactatccttattagtacaaatggatcaattattagactgattgacgcttcca

SEQ ID NO: 81 - DNA, 1190 bp, Diabrotica virgifera
  Annotation=Protein phosphatase 2A, 59 kDa regulatory subunit B, putative
  SmartBlast Evalue=1E-117; Info=Protein phosphatase 2A, 59 kDa regulatory subunit B, putative n=1 Tax=Pediculus humanus corporis RepID=E0VNT7_PEDHC
ctagaaaaaatacctgggtaaccaaaccaaaacaataataaaaaacatttaattaaatgtccttatttttacatttcgaaaatgaatttggatagtttaaaacaaaaattaaaaaggattgcagataaacaaaaacctgatgataatactgaggagatagaagatactcattttcagaaatatctaagtgaatggaagaaaaaggatgtccgaacagacgaaggaattccaaagttttttaataagattcctaaggaacatgaaccacttcgagtcaaactaagggaggaaagcagatcaaatttatttaagagaaagagtttacagctacttgacaataacgaactaaaagaactatgggtacttttagatcagaaccaaagcaatccagaagaacaattgatcagttacacagactttcagaaagtggctaatttggcaggggccaaagtcaagccgtattttacttcagtattatttgccaaattacaacaaggtgatcctcaaggaagagtatcgataatgtcattatttaactatgttatgagaaaagtttgtttagatcaaactagaatcggtttgtcgttatatgatgctactggccaaggatatcttacggaagtagatttagaaaactatattaccgagttactaccaactctcccacaattagaaggattagagaagtcttttcatactttttacgtttatacagctgtgaggaaatttttgttcttccttggtgttgttcgaacaggcagagtaagaattttagacatattagcctgttcgtttctagacgatttgttagacttaggagatcaagagctcagcaaagaattacaagaacaaaattggtttagtgctccgtctgcattaagaatttacggacattatttgaacttggatagaaaccataatggtctgttaagtaaggctgagtttgccgggtatggatcggggacacttacgcaacctttttttggatagcgtgtttcagacttgtttgacttatgggggagaaatggattacaggacgtatctggacttggtgcttgcattagagaatagaaatgaaccacaagcattggcatatttgttcagaatattggatatcaagaaatgtggatatctggatgcttttacactgaaatatttctttagggcaatccaagatcaaatgaaggcac

SEQ ID NO: 82 - DNA, 1632 bp, Diabrotica virgifera
  Annotation=Translation initiation factor eIF-2B subunit delta
  SmartBlast Evalue=1E-103; Info=Translation initiation factor eIF-2B subunit delta n=1 Tax=Camponotus floridanus RepID=E2ATF3_ 9HYME
gttttttattacacatttaatcagaaaaaataaactcggttaatacaataaaacagtaaaaagtctttaggtagtttctgtagcgataattctcaaaactactggtacacttgtacaaggcagaatagcaagctcggtaaccactgctgtaaccaaatcaggaggtgtcacgtcatataacaaactcaaaggcgttagtttcggcatgtctttccacttggacaggggtgttggcgtgttattaacgtgcgtcacacttagagtatcaggatctcctagttcattatatacaaaagagtcagtctgaactctttcactaaacttataagtctcacaacaaactagtacgggtttgttgtactcccgagcgaccaatgcaacttgagctgttcctattcgggacatgacatagccgttcgtcaagagagcgtgtgctcctaataccactttggtcactgagttcattacataactaagagcgtttatcaggatataactacaactaacaccggcaactacaagtcttcgtagcagttcccttccttccaaaagaggtcttccatcaactacgattactttgaagtttttgccatcggcgtgggcttctaggagaatttttgttataagagatgagcatccaaatgttaaaattacatccccgttgctgattttcttactaactttcatgcttatagcatcccctgctttattaatatcatcatggatatatgtatcaataatatcttgtagtttaattttcttttcagtatcttttatattagtatcaatatgggttaattgtaatttaaaatgtctaagggcatttgtcatcgaaacagctaaaggcctacaagaatgtaaatattgtgtacaggtttgtaacacagtttctaagtatctacagaattcttgttttggtggggaattgagatcttgcactagatatttcagggctaccaaaagtgctaaacatctcgcatttgatcctaggataacttttttgttgtattgaactcctagcctaataaacacaggatgaatatcaggatgtacagctatggtatgtgtttctagttttaataggtcttcattatataaatgctgtaccagctgcactttatgagaatcagtaacctttttaacttctttcttggtaattggtttcttttctgttttctgtttattatcgtttactacttttttattatttgtattttctttctcttttagctcagaaggagattttggtacttgttcaggtttttgttttttctcagcgtctttttgttgcctctgagcttcttgtagttcccttcttttagcttttagttctgccttacttaactgctcattttctttattatctttagctttctcttcttccagttttttggcccattcaagtcttcgcagttcttttctgaaagtgttttagaagctacattgtgttcattggatttattttcttttttatttacaccaccactttcgacttttggtttattgttcggatgggaagtactattacatttgggtaaattagggctttgtgttgcttcaccaggttcttgagtctgtctagcaccttactttttgtgctcttctttctttttttgttaaaccatctggagc

SEQ ID NO: 83 - DNA, 856 bp, Diabrotica virgifera
  Annotation=Nucleoporin seh1, putative
  SmartBlast Evalue=1E-110; Info=Nucleoporin seh1, putative n=1 Tax=Pediculus humanus corporis RepID=E0VH27_PEDHC
tttggatcgtcgcttcccactgctatcatttgggggtgcattttagacaaactaggattccatgataaacaactgcatggaatcctagtttgtctaaaatagcacccccaaatgatagcaatgtcatgtacaggatccactactgaacttatagtttctaattttgtccatcgtctactgttctcattgtattcatagatgaacactttgccgccatttgctggatttggatcgtcgcttcccactgctatcatttgggggtgcattttagacaaactaggattccatgataaacaactgcatggcagcttgcattggacttcgtgctgtaatgtccactgactcaaattcataacgtctggagcttcataaattcttataattccttctgctgaacaagtagctaactggagtccttgagattttggtccaaacttgacatctgttactgaagtgcgggaatccactagatttgttctccttacccaatgtctggtacctctttcgcctggtcctggtaattctccaactatttcttcccaaacagctgctgttctgtcaaaggagcaagtggctaaaacttgcccaaattcaggatgggcccaagttactttccatacagatccactgtgtgctttccaacttgatgttaacacccactttccatcagatgtttgatcccaaaccttcacaaattgatcacttgaacaggtggccattctcctcccataataatcataagcgacatcgtgaatgagatctttatgttctgcgtgaatttcttgagcttcaaacattttttattttaaaaactaagatgtaaaccaaacgccaaaccgaaaaactacaaacttat

SEQ ID NO: 84 - DNA, 1856 bp, Diabrotica virgifera
  Annotation=Rho-associated protein kinase, putative
  SmartBlast Evalue=2E-40; Info=Rho-associated protein kinase, putative n=1 Tax=Pediculus humanus corporis RepID=E0VTK4_PEDHC
cagtcagagtagtataaactttgtgtgagataaacgtactcgacgcgatatgttattggtttgtttttgttaagcggccgcaggattcgttatcgtttgttttgtgcgactttcactgcgtttccctttaggaccctgccttgcaggtggatactcttgcaggattttggcgggtattttttctgtaggtcagaacttcgtcatccatgtaacaacaagaaatgtccgttatcaataaacacccagtaccgtctaaattaagcacaaatggcacctcgaatataccattaagaagaactatgcagagacaaatatcatcccctatatcctcaaaaatccccgtgacagaaggtcaagctgtacgatggaagcagaaattcgaagaagccgaagaaaaaagaaaggccctgctgaccgagaaggagaaggctcttaggaatttgacggatatagagaaaaagtatttaaatttgcagataaaacacgaccatctggaaactgagttgttcgagaagaacgaagaattcaccaaattgtcaacggcttcgaaaaatctttataaggagtatgaaacgttgaagaaccagtatgaaactgagacgagggctatgacaggagccttgaaggacgcttcgcaatggtaccgggaaaataaggaactgaaacgaaaaacccttcttctgatggacaaagatactgtggacgaaggagtagacgcgggggaaggagaatccaactctgaaaccgatattgaaaacctaaacaagactatcaaacaactgagcacggaaatagcagagttgcagacagaggtagatggtttaaagcagacggaattccagacgtcggaagataacattaggttgacggaggacttggaatccgagcgacagaaaaacatcaaattggaattagaactttttgagttaaaaaaggaacacgaacaaaccttacgggttatggagatgatgaaaaaagaaatgaaggaattgcaaatgctagaagaagaacataggacaaatctcacaaatttaaaaaaagaatctgatgcccacaagagagagaagaacgtgctaaaacatcaaagtacgttgattttacaaggactgaatgaatcagaaggttcggataattatttattgttgctacaagagatagaagacttaaaaaggactctagaggacgagaggaacaaacacgacgaagaagttaccattctacaggaacgtctagaagaccaagacaacaacgctcagatagaagtcttggaagaacgattgaagctcgtggaatccgagcttcaaaccgcaacggaacgtgctgaaagagctgaagaaaagctgaaagctcctcccgctccaccaccgcctccaccacccccactacctccgatgttaccgcccctttcacttcctgcttcagatccaccagcggtacctttgaggagaagaagaagtaaagtggcactttcagatcttgctgaaagcataggagtacaggaaaatacccaatcagacaagaagccagctgcagctcctggtgtcaacgaggacatcattaacgccataaaagcgggccagttcacgttgaggaaagccaaaaaggagaaggagaagcaagaacagaaggagcagcctaaagcagtgtctgaactacttaatattttgggtagcttaaggagagcacccaaaaagaggcagagtcaattctatggggatttaactgtgaatgcatgagatatattaccattactttgttttatgttaaccattagattatattgtaatttagtaacatattgtatatgtattactatattgtattatttttgttacagtaaagatagtttatatatt

SEQ ID NO: 85 - DNA, 1174 bp, Diabrotica virgifera
  Annotation=Golgi resident protein GCP60
  SmartBlast Evalue=1E-79; Info=Golgi resident protein GCP60 n=1 Tax=Camponotus floridanus RepID=E2A2D9_9HYME
gaacctgattctaaatcgctagttcgtatcgtttcttcgtcaaatacttcgtcgtcatcgtctagttcatcgagatcttcgtcgtcgctttctgagacgtgtacagagacttcttcagtcttgggagttccgaattcgaagtatacgccgaaacctatatcataatgatcagtggcgaactcccaaaataacctcgacccgtgcggatgtgtcggtactctgacggtaacggtttctccgtgtcctactctcacgacaccgtcaccttctccttgcgagacactttgtttgaaagcgtccacttctgctctggtccacatactggcagttacgatgttcatctcttccgaatcattgttttgggagttggaaatcgatttttcgtctgcctgctctgcaacatcaacagcatcttctttatccgaatgagcatccttatggttttctttttctctttgtgtcgcctgtaattgttgcatatactgaatgtagtgttgttcttgtagttgttttatcaaagaaccttgtttttcagggtcgcctggatattgttgctctgcatacttcctaaactgttcataggtctgttgatttaaagctaattggatctgtctcttaattgcctcctgtctccacatttcctcttgcagtaccttttcttcttccaatttcttcagcctttcttcctcttccaccttttgcctttcctcttcttgatgagctcgcctctcttgctccttcttttctctcctgtgtgcctctatgtacgtcgaaaataaaggacatttcctactaagtaattctacaaaacctgccctagcttggtcggccgaaagttggcccaatttttgccacgctactctcctatctctacccacaacatccaaagtccccaaggggggcaatttatgtactgcatcagcataggggccgtgaagcacttgctgggagaacgctactaattgcaatttgtcttcatagctatagtgtaccgctttaccttctttttctttataaaagttaaaacctaatttatacacttctttcaggggcaggccatattctgctgtttctagtgtggcagtacttttattgcttgttgtcgtatttccattttctaaggctattttgttaaaattatcagaaatttgggaactgtcactttcggtagcca

SEQ ID NO: 86 - DNA, 976 bp, Diabrotica virgifera
  Annotation=Coatomer subunit epsilon
  SmartBlast Evalue=1E-90; Info=Coatomer subunit epsilon n=2 Tax= Formicidae RepID=E2B137_9HYME
caaaaatggcacgtcagcaacaagacgtggacgaacttttcgaaataaaaaattatttttacattggaaattaccaacaatgcataaacgaggcacaaaaactcagaaagccgtcaacgcccgaagtagcagtccaaagagacttctacacctaccggtcctatatggcccaaaataaattcctagtagtattagacgaaatccacggggcatctcccccagaaatccaacccctgaaatacctcgctgactacttagcaggcaaaatcaagaaggattctgtggtggctcaagtggagcaacaagtccaagcaaatgctaacaatgatactctaattttggtagcagctactatttatgttaacgaaggcaatcttgatgctgcgtataaagttttgcacgctacagaaagcctcgaagcaatggcctttattatagatatacttttgaaattggatagagtagatttggcaaggaagaagctgaaagagatgcaagataaggacgatgatgcaactttaacacaactggctcaagcttggattaatgtatccactggtggagataaactccaggacgcctactatatttaccaagaacttgtagacaaatatggatccactccattgttgctaaacggacaagcagtgactttcattggccaagccaaatatgaggaagccgaagcagctcttcaagaagcacttgataaggatgccaactatcctgatacacttgttaacatgatcactcttcagagacatatggccaaagcacctgagattgctaatagatatctgtctcagttgaaggatgcaaatcctgatcatccatacattcgtgatctgaagataaaagaaaatgattttcacaggatttgccagcaatattccccttcagtttctaccattccagcttgattgtattattttgtatagaattattaataaatatttaataaatgtaaatttcagat

SEQ ID NO: 87 - DNA, 1382 bp, Diabrotica virgifera
  Annotation=Suppressor of profilin 2
  SmartBlast Evalue=1E-158; Info=Suppressor of profilin 2 n=1 Tax= Glossina morsitans morsitans RepID=D3TPI0_GLOMM
tgataagtgaagtgacgttttgttatgttaactctaaatttgtgattttaattttaaaaaatagtgcacaactcttttaatttatgtgttgtagtataacttgagttaattctgtaaaattcgtgttgactgaccagagtccacgaataatttgtataactttacgatgactgaacaacatagatttggaaacatcattcaacctataacatgtcatgcttggaataaaaacagaactcaaatctctctgtctccaaacaatcatgaagtgcacatttaccagcggagtgctgccgaatggaaacttttagatacgctgaaccaacatgacttgcgtgtaatgggaatcgactgggctccaaacaccaacagaatcgttacttgtgctgcagaccgaaatgcgtatgtttggactcaagataaggataacaagtggaagccgacattggtgctgttaagaataaacagagcagctacatgtgtgaagtggtccccagatgaaaataaatttgctgtaggatcaggggctcgcttgatctctgtgtgttatttcgagtcagaaaatgattggtgggtgtcaaagcacatcaagaaacctatcagatctacagtgacttgcttggattggcatcctaacaatgtgctacttgctgccggatcttctgatttcaaagtcagagttttttctgcttacattaaggatatcgaaaagactcccgaaccgactgcgtggggttcgaaaatgcctctgggacaattgatggctgaatttgtcaattccaacgttggagggggttgggttcacagccttagtttttctccagatggaaacaaaatttgttgggtttcccatgattcctcgataaatgtggcggatgcaagtaaagggaatgctgtccataaacttcgtacagagtttttaccatttcttagttgcacttggatcggcaataaatcagtagtggctgctgggcacagctgcattccgatcgtatatggactcaaagataatggtcaattagcctttactgcgaaattggatgcttcccagaagaaggaaagcggaggattgtcggccatgagaatgttccattctttggacaaacaagcaagaagtgaaacctctgataccaatttagactcgattcatcaaaacgccataacttgcgtctgcatttacactggaaaaaaagagaaagcgttgaagatttctacatctggagccgacggacaattggttatttgggacttgaattccctggagagatccattcaaaacctaagaattgagtaaagagaagtgttttaaaaaactactttgaaataaaattttcattttgtgttttttaagttactgaattcgaataaatggcaaaacttta

SEQ ID NO: 88 - DNA, 770 bp, Diabrotica virgifera
  Annotation=Nucleolar protein 10
  SmartBlast Evalue=2E-98; Info=Nucleolar protein 10 n=1 Tax= Camponotus floridanus RepID=E2AQ01_9HYME
aaatggaatggaatcgaagaatgtaaaataattttaatacaagatgcaagtctcagatcccaataacattaaaatatataatttaagtgctggaaaatcattaccagagtggttatctgaaagaaaaagaagggctttactaaagaaaaatgttgatattagaagacgaattgaacttattcaagattttgatatgccaggacttagttcggcagtacgagtatctaaagatggacagtatatattggcaactggtatatataaaccaagaataaaatgttttgatgtgaataatttatccttaaaatttgaaagatgttttgatgcgaagctgttacttttcaaattcttagcgatgactatagcaagttaatatttcttcaatgtgatagatatattgaattccatgctgcttatggtcgttactacagattacgaatacccaagtttggaagagatttgcaatacgattttcccagttgtgatgtatttgtggttggtgcttcttcagacatttatagattaaatctggaaaggggtcagttcatgacaccatatacaagtactgcatcatccattaataaatgcaccattaatcctgcacatcatctacttctttgtggtactcaggagggaaaagtggaagcttgggatcagaggactaaaactatggttggcagtttggattgtgctcttacttgtcttagcgaaaataaagacatggaaggatttccatcaataacagcgttaaaattcaatggaggattaca

SEQ ID NO: 89 - DNA, 2253 bp, Diabrotica virgifera
  Annotation=CCR4-NOT transcription complex subunit 3
  SmartBlast Evalue=1E-104; Info=CCR4-NOT transcription complex subunit 3 n=3 Tax=Aculeata RepID=E2AHH4_9HYME
ctgaaaccacatcatgtacttggtgtggaatctccagcttgtttttgagcgctttcgccgcgaggtattgggctttagtaccttccatgtagtagaatacaaaaaagagggtctccgtcgctaatctctggaagaaatctaaactctcagagtgggcgaggggcgtttggatatagtacgaaggtgttgtgcaagggctccttggcaggtacgttcttatcctctccgaatctgaagggtgaggcatgtggtagtacgccgcttccataagttggaactgggtctggtgttctttttggagaggtatagcgcccagtggcgcaactcccagtaaggggggtatgtgggcgtcagacttgccttggttttgtaacttgcttggttctagaatgacttggttgttttgtaggccagcttggtctatcacttgttgagccatggacttaagggatgtcattccttcgcttatcttctccgtcgtcgtaccattcgggacttgctgtgatacatcaacgtcagaagttgacatttcactgccattatttggttctggacttatgcaattattttgtacatgttgttcattatataattttggagggggatttgttgaattttgtaatcctaatgacgcaatgggatttgtatggaccgttgtattaatggcattggatgtgttttgagtttgaacttgactaacaatggttatcacagatgctggattgctctctccgcttgctgtcgtcgtcttcgccgcactagctgccgcaaccgcagcgaagttaccgcccatcgatgacgtcgttagggactgcacaagcgaaacgggagaagcttctcgtcctggctggatcttgttgccgacagcgttgccgacgggcgttactatgccgccgacgacgctgttcgccaacgataccgtcgttttgcccaccgaaggggctaacgtcactcctataggattgatagccgaggggggcggtaacgacgacgtcaccgctcctatactgcccaccgaactgtaatttagcagggaattgagggggtgttcgtggtggactggctattggttactgctcgaaccggcattggtttgataggacacaccttctgttctttgcctacaacctttttactgtcgtcattcgagttttctccggaatggttgttgtaattatgcaggacgctgttagccgccgctgcggcagccgccgtcgccagtgacgtcatcgttaagggcaccgaagacgtgggcggttggagtggcggtgatgatgagggcgggggcgacgaacctgatataattgaggtaggtgtaccaccagtctcattactatccgtcgtcgcagaagaaggtaatgcgacgccagataattcaacttcgtccataccaataatgtcatcatagataaattcattgtcttcgaaatctggctctgtgttaaagtctatataatattcgacattgtctctaatatttttaatctgttgaacttccactgacatgttatctagcatccttaatagcgtttctaatttccgtatgtgaaatttatgtttatccaacctagatttcagatcttctattctatcttgtttgtctttgtcgagttttttctttttatttgataatagctgttctatttcagattctaagctatcagaaccgatattaagttttgctatcgatgatgttaaccaatattgtatatcatctctttctttttgggcaggatctaatttctgagcagcacctagaccttcttttgagtacgctttcgttttagtttcacgttctacaactttaaacctctccatttgcgtttctataagttttctgttgtccattaaaatacttttatctttaatttcagccgatgctatccaactcttaatttgatcccttagcctttgtaatttcttaatttcctttttgagatcagcctcatatttctctttttggttactattggtagcattatgaactttttgccagatgtcttcaaatgtatcgaccccttctgtaactttttttaggcagcgatctatttccccttgtaattttctagtagccgccatgtctgctctcttcaattcataataaaatttgcttcctatttctaatgacctaaatctatcagtaccattccaaaataccgttacattcacctataataatataattgaaaaactgataagcctcttcgtagccttttgatccacgaaatattttttttaaacataaataagccc

SEQ ID NO: 90 - DNA, 1304 bp, Diabrotica virgifera
  Annotation=Nimrod B
  SmartBlast Evalue=1E-115; Info=Nimrod B n=1 Tax=Tribolium castaneum RepID=D6X4K9_TRICA
aacttccttataactttattaaaagtctcatattttagaatacataaaaatttataaaatctcaaaatttagagtaaaaaacatcgtcacaaacaaatatacaaactaacagtttacagtccttctaaaactgcttcagggatcaactccatgtgcatcaatgatcttctgactcttctaacacagttgttgcttcctttgcgttcctttacgtagccagggttacaaatacagaaattgggggctgtacaagagccgttagggcaacctcctgggcaatgggctacgcaggtctggcttctaatggagtttggagcttcaatgtaaccttctttacatttgcactgattaggggcaacacagtcaccattcaggcatggattattgcagtgaggagtacaaacggttccagtaccatccaaagcccatccagctttacaagaacatctgtttggtgctacacagtctccattgtggcatcctcttgggcaatctgctacacaagagtgtccagcttgtctatatcctggtttgcaggaacattggttcggtccaatgcagcttccttctccacagcctccttcgcaatggtagttgcatttgcgggttcttgcatccaaagagaaacctttgtcacaagcacaggtctcaggacctacgcagtttcctccaacaccacagcctccgctacagtgaggaaggcagtattttccgctagagctgagtgtgtttccggcattgcaggagcattggccagtgatggtgcagacaccattgagacacctttctgggcaagtaggaatgcagtctttatggtagggatcatggatccatcctcgcttgcattcgcaatgaccaggagacgtgcagttaccattttcgcagtgatcacagacaggctcacattgcaagtgggttcttggaactctttcgtatccactacagcacacatctattttactgtatccgtttctggatccatttcctctaggtataacgccatgtctgtcttctgcaggaattaggtcaatagtaggaacttccaaggtacagatacctcttctggagttatttcttgctactccctgcagctgagcggcttctacgctctggctcagaagagaaaaggccatcaaggccgtggcgcccaccaccagcttgaaagccatattattatctatctattttttttaaaccactttcaatatcaccggatgccggtatcttctgcgtccgtagcttctgttaattgtcgtgtatctgctgatggtttaaaataaacgtggaatgtgttcttgtgcttg

SEQ ID NO: 91 - DNA, 1831 bp, Diabrotica virgifera
  Annotation=Probable splicing factor, arginine/serine-rich 7
  SmartBlast Evalue=6E-93; Info=Probable splicing factor, arginine/serine-rich 7 n=1 Tax=Camponotus floridanus RepID= E2AID9_9HYME
gtcgccatattttgttgctgtagtcggcaagtgaaattttaaaataatatgtaaatcatacataaagtatattatttacattaagaagtttgttcccgccgtaagtaactattgaaataaaatggcagtgggttcaacaaaagtcgtccaagtgacgaatatagctccccaagctacaaaagatcagatgcagatattatttggatacttgggtaaaatagaagatattcgcttatatcctaccatcagagatgtttcctgtcctgttcagtcacgtatttgttacatcaaatttgttgatagtacaactgtaggaattgctcaacatatgacaaacactgtttttatagacagagctttgattgtgattcctatatcaagtggagaaattccagatgaatattatgctcttgagatgactaaaaatgggacaatagtaccaggtctaactccaactgatccaaaattgccccctcatgttatcaatacaattcataggacagagcaagaagaagtaataattacctcagatcctcatttgcatgttaacggtttgcctccgtatccaccattaccttcaagttacgatactgcaaaaattgaagaaacacgcagaacagtcttaatgctgaattaccagcctttgttaactaatgatgatataatcgacttttttaattcagctggagaagttaaatatcttagggcgtgtaaaggtgactcggatgataaccaacatatgcttattgagttttccgatcaagcaagcatagtaaatgcattaaaattgaatggccaagaatataagggacaaataataatagtagaacatgcaactcaaccaataaccaaaccacaagcaaaaagtaatgaggcagcccaaaaggaaattgaagaggcaatgtctagatttaaggaagcgcaaaatatgattaatgcatctattgaaccagtcattggcatgcttacaaaagataaaaggagtttacgtagatcaaggtctagatcaagaagtagaagaaagaggtccaggtctagatctagaagaagatcaaggtccagaaggcgaaggtcttcatctagatcgagaagatcaaggtcacgggaccgtagaaaaaggtcaagatcacgaggtagacgacattctaggtctcgagatcgacggtcaagatcgagaagatcaagatctccgagaagatcccgatcgaggtctagaagaagatcacggcatcgatccaaagatagatccagaggaaagtcccgagatcgcgatagaaaatcaagagaccgctctagagatagaaaaaggagcaatgaaagagaggataaggataaagataaagaaagagaaaagaaatccaaggatatagaatcaccagaaaaggaaaaaacgcccaaagaagcaaaagaaaggaaaagtgacaaagaaggcagtgctgaggaaaaacgaaaatctagatctagaagtaaaagtaagagaaggtctaggtctagagatcgtcgaagggatcgaagaagaagtagatccaggggaagtagaagaaggacgccatctccaagaggtccaagaagaaggagcagaagtagaagtcgagacagggacaagagaagagataaaaaatctgataaaagagataaggaccgaagagtaagagataaaaggtctagatccagagataaagaaaaagaaaggaagtctaggtctagatcgcgagatagtagatctactaggtcccattctaaggttccaaggaattatgatgaagaggaaaaaggttttgacactgaaaaagacaaaccgaaagaaatagaaagtgagaatatagaaaaa

SEQ ID NO: 92 - DNA, 1459 bp, Diabrotica virgifera
  Annotation= Leo1-like protein; Pfam: PF04004
  SmartBlast Evalue=1E-101; Info=Another transcription unit protein n=1 Tax=Camponotus floridanus RepID=E2AGX6_9HYME
atcttcttcattatcgttatcatcattgtcttcttcgtcagagtctttgagagctttgcccgatgtaccctttttcttagttctactgttttcaaaatctgatccgtcttcatctgatgaataaatagccccaccttttggtgcagtacttccgcctttatatttacttttaattgcagcaagagaaattgctccgtcgtcatcactaccttcttcctccctaacaaaagtattttcaagtgccctagaggctttgtcggacttctttctagtagtttttggtttggatgccgattgcctaagtttttcttcttctttctttattcttgttgctttgtctaaatcaggatccacaccaacttgcgacatgattttaataccacttgttttggtagatctgtcagccaaagaaagagtcatctttctgtgagtgaaactttcagttgagtgcggcctaaagctcaactttgttcggaatactgcttgaccttgtaaacctgtaccttgacgaataaacaagtggttgtggtctccctgtaatggttgtttatatacgtcaaagatttcagagcctaaatgtagactgtaagacccatcagaccatcttactattctagcatttgattcttttttcatatttccttcatcgtccattgattctttccatctaatggtattttctacttttagtttcaacctagctctaccttcttcatccaacgtttcttcttcatcaatttcatcttcataggtttcaggatcaaaaggacgtgtttctacagataaaaagttaggcagtttaacaaaatgtatatctctacctaaatcacaggttatttttggaacttcgacatcaattctagtctctggtattggttcaggctcattttccttatcttcgtcatcagcaatagttggtctttgatccgcttcatctcctgatctggatcttcttccatcatcagatctagatctccttccatctctgtcatcttccctatctgaatccattctttcatctctcttttcatcctcactactaagactgatatcatcggcatcaccaaaaatgtcggcagcatcaactttttctgtttcgcccttgccacctccctcatcttcgctgtctgaaacaaccgctttccgttttttagttactactctctcttctgaactatctctctcgcgtttttcaccaccctcaccttcatcaattaataagtttggactatttgagccacttcgaacttttgattttgatctggatctagatcttgatttatcagatttttttgatcctgcagaacctgatctagatcttgatttgtggctctttttagatgctgctgatcccgatcttgatcttctagaaatggcatcggattttttgatcctgcagaacctgatctagatcttgatttatggctctttttagatgctgctgatcccgatcttgatc

SEQ ID NO: 93 - DNA, 749 bp, Diabrotica virgifera
  Annotation=Vesicular mannose-binding lectin
  SmartBlast Evalue=1E-103; Info=Vesicular mannose-binding lectin n=1 Tax=Aedes aegypti RepID=Q16SI7_AEDAE
ggtagttgttaaatctagacattttaaataaaaattgggaaagatgtttattaatttatttcatattgtagccatattcttatattgtagtgtcattcacgcacagccacaatggaatacacgagatttcatgaaaagggagcactctttaataaaaccatactatggttcgggattagatattcctttctggcactttattggaagtacaattgttaccccaaactatatacgtcttgttgatgattcccaaagtaaatggggtgctatatggaatactgttcctgttaccagcagaaactgggatatccaagttcattttaaagtccatggtaaaggaaaggatctctttggtgatggatttgccatttggtatgctaaggatagattaaccactggtcctgtgtttggtagtaaagatatgttccaagggttagcgattattctagacacatatagcaaccataatggtccgcataatcatcaacatccatatatttctgccatgattaacaatggtagtttatcttatgatcatgacagagatggtactcatacacaattggctggatgtgaggctaagttcagaaattttgatcatgatactcacatatcaattagatatgaaaatgatgtgttgacagtatccactgatttagagaataaggctgcttggaaggaatgttttcaagtgaaaggtgtgaagttacctacaggatattatattggagcatcagctactacagggg

SEQ ID NO: 94 - DNA, 855 bp, Diabrotica virgifera
  Annotation=Two pore calcium channel protein 1
  SmartBlast Evalue=2E-79; Info=Two pore calcium channel protein 1 n=1 Tax=Harpegnathos saltator RepID=E2BLT9_9HYME
gtctgttgcttgtactggatcctaaatctgaacgcttccaaaacagaagctacaactatcgtcaacacaaccatcgtaaacaaataaaacatcatgaagtacaatcgcgaaaacttatttttcgattgaaaagcataggcgtccatgacgatgaaccagttgttgaccactgtcagttcgaacaaggtgacgcctgaagtcaggaggttcgagaagttgtttagatagtagtagccgatgccgctagatgtcccgttggatttgtaaaagtcttccacggtgctgttctcgcaacagttttttcaaattatacgacgaaaacagctccattcctattatagcgaagaagtaatacatgaccatcataactatcccagtagaccacatcaatggactcagaaggaccaatgtgccgaaaatatctcgatacctctttttcaacttaaacaatcgtaataacctcaaaggtcttaatatgactactgccgtaaggttcggtaacatggatagtaaaaatgccccaattaaagcagaaagtgtcactgataggtcgaagatgttccatccggatgatatgtattccgcccatcctagtccgattattcgcaatagggcttccattaaaaacaatattaaaaagaaataggtatcccatgaggcacaaaacaacttggcaccttcttccaaagaatctgagttttgcataactcttacgaacattgccactccgtttgctattattaaaacataaacaaaatgttcgaagaagggccacgtcactaacgtttttgccgcccggcaaaaggctctaagtgggggccacgccgccgaaaaccatggatccaatggtgtctt

SEQ ID NO: 95 - DNA, 1031 bp, Diabrotica virgifera
  Annotation=39S ribosomal protein L2, mitochondrial
  SmartBlast Evalue=1E-88; Info=39S ribosomal protein L2, mitochondrial n=1 Tax=Culex quinquefasciatus RepID=B0WP17_CULQU
tcacacatttaatacttaataatgatattggaatctaagagtttttacaaatggtctagtaaaggtaagttggattggttcaacattatctattggtttagcaacaattgttcttactggtggaggccttctaatttttctaccatgacagcccctctttctttgccacaaaccagatcttggcctattgcccaattctctattttttccagcagagccaatgggagtactgccatgctctacattactcagccttccaacagtacacatgcactgtgctggtaaactaaactccttctttgagggcatcatgataataacaaaattatttggagcttttcgtaagactgttgcatatgttcctgcagcatgaaccaacattcctccttttccaggatacatctcaacattgtgtatttgagtgcctattggtattgcccctaatggataagcatctccttcattagctctcacagggatgcgtggaatatagcaagaagttttaataatatctccaggtttcatattaacagtggccaaaatgtatttcaatttatctccatatgcaactaaagcaacatttgcagtgcgacatccatctttaataattttaataaccttttcagtctgtacttttccttcttcatttggtccaatcctcttccaatctatccaatggtacttgtgttttattccacctccgattccctttacaaccatccttcctgttttaggatctcgacctcccaaattggttacatctaaaggttttaccgtgtattcttcaggataatgtactattctgcgaaaacaatttccacttccaccaccaattgcaggcaagggtactatttttgctttatatcggacactacttattattggagaaatatgtaaattgtcaagaactggatttaatttatataacgttctggttaacgaattcattttagtttagagttagtactattttctattttatttaaaattattttagaataaaataaatgaacattaagtatgcattgaca

SEQ ID NO: 96 - DNA, 747 bp, Diabrotica virgifera
  Annotation=Zinc transporter 9
  SmartBlast Evalue=5E-91; Info=Zinc transporter 9 n=1 Tax= Harpegnathos saltator RepID=E2BMF6_9HYME
gccttgtatcgtaccaagtaactacccatatcaatgcctttcacgtcatgaattgctctaatcataatatccctctccaattcggtatttattttttctaaattttcttctggtattgatctgcctacaagtgctgcaacattggtgtatattataaaagatgctacagagcccaaaatacacccaacaagtagtgatcctaaagcatcaggtacaggactatttgttacagaagacacccccatacaaccagcagccactataactccaatcacagcggcaaagtcttctaacaagacaacatttacactaggatcttggcctctaaaaatgtactcctttacagtcatattgacttctctggcaccttttcttattgaattaaatgcaactaaccaagtggcacctccgatactagagaaccacataagatgaagtaggcccaaaagaagtcttccaatggagttggatgaagcaggccagatatgccatggtaaactgacaatcctgtacctacacaaaagattccaacacctgaaatcaatgatgctacatacttcatattggagtagccatatggatggtaggaatctgcaatctgaacagacttgtgaatcccatacgctaaaataagctggttgattgtatctgctaaagaatgaatacattctgagaacatactgtgggaaccagtgtacacccatgcacataacttaaataaaaaatttgttccatttataactactg

SEQ ID NO: 97 - DNA, 1255 bp, Diabrotica virgifera
  Annotation=Cmp-sialic acid transporter
  SmartBlast Evalue=2E-99; Info=Cmp-sialic acid transporter n=1 Tax=Aedes aegypti RepID=Q175F9_AEDAE
acaaattacatcaacaatttagttaacttttcaagtttgcaagataatgatatcttaaaaaagcttcaagtaatgaattaaaatatacactcagatttaaatatattgtcaattatgctaaaacgatgttaaccggtgtattaaaacaatgtctagtttgaattggaaagaactctttccaacgaaattaagtttgattatctttatcggctacatacttttatttgttaatcaaggaattttggtaacagcttcacaacgctcagacaacaactacaactataatatcgtaacagtagtactattgacagaagttttaaagttagtcatctcgtcagtcctatattgtaaagataattctactggtcaactgatctctgaagtagtcaagcacaaacatgtattactcctctactttgttccggcttttttatattgcttatacaacaatttggcctttttgaatttatcctcgtttgatccaactacttattttttattgctacagttgagggtagttgtaactggtgtgcttttccaggccatctttaaaaagattttaagtaaaagacaatggatttcgttagtgatactaacgtttggctgcatgctaaagcagattaacttgacgcagactacctcgaatacctcgtcaagcaataacaccaaagccgcttcagtttccttaggaatagatgccatattcatatttattcagataatatgctcctgtctagcaggtgtctacaacgaatatctcctaaaagataaaggtgcttctataaatattttcgtgcaaaacgtattcatgtatttggattctatagtttgcaatgttcttctgctcatactgaacggaaacatcttagaagcgttcgtttatgaaaatattcttaaagttttacattataaagtcttattagtgatgttcaataacgcagcgataggaattgtaacgagcttctttttgaagaatcttaattctattttgaaaacgttcgccagtgctctagaactagtctttacggctctattaagttacctttttttcagtattccgatttatttaaatacagtattaagtattgctactgttatgggtgctacgtacttatattcgcaaaatcctgttcataatcctcctaagcctgtgcaggatgatagtattgaaaaagaacgactgttggaggaggtgtgatatgtagttagcatagaaccagtttgtttgatataatctaataaatcatgttacgtt

SEQ ID NO: 98 - DNA, 1016 bp, Diabrotica virgifera
  Annotation=Sparc
  SmartBlast Evalue=2E-93; Info=Sparc n=1 Tax=Schistocerca gregaria RepID=Q5MKL0_SCHGR
aatatttacaatttatatgtaaggtccgcattactctgctgaaatatcactaatttcttcacactggtgctcaatttcctcctcttccagttgaagacatttggcccattcgtgaagtgtaattctgtggttattatctgcatcacatgaatttaagaaagggctaatacaatgttccaaagccatcaatggtgcgcgaattgggaacagctcgtgacgagaaacagatctgtctggtggatttccatctaaatcacagaatttccagacagcagcatttgtccaacggcgagtcatgtttgattcagcttctttttccatgttcatgtaatgaggagtaagttcttgacggtcagccaaatctctcataatgttgaaaagccaatcacgcattctgcgtgggaaatcagccatttcttcttgagtacaatgaggcatttccctacattgtccgtaatattcaatgtgtacatgtttatattggggtcctttgcattcctggtctcctttagcacacaagcatctttgttggtagatagcgcaatctgaagaccacgtttcgttgtagttggagcatactttacgacgagattcactttcttctggacaagttggaatacaaacacattcaggttctctcaactcattgacttgacagattcttccggctccacaacggacctgcatacatggatccactaatggaacccgattgtcgatatcctcatcacctggtggagctattggaatagcttcttcagattgtatatcatttttagaatcaaaagattcaatgtgtattggcttccttctggtctttttgcgttttactactttctcagcagcaatgtcagtgactagaaagacaatgagaaaaattaatcctaagtggcacagcttcattttatctgctgaatttcaattcagccagatgttccccttgtttcagtgcacttaaaacagtgactaaactaactagtgttgactggttgtatgaatttctcatctgaaagagc

SEQ ID NO: 99 - DNA, 1083 bp, Diabrotica virgifera
  Annotation=RGS-GAIP interacting protein GIPC
  SmartBlast Evalue=1E-102; Info=RGS-GAIP interacting protein GIPC n=1 Tax=Bombyx mori RepID=Q2F696_BOMMO
tagtctcgtttcagtgtagcaagtgtcctgtaatcgttttgtaattgtgtgccaaataaaagaataaatatgttcaaaaaacagaaaaaaccttcaaaactaaatagtgtacaaagtgacaaacgcattgatcctgtgccaagacctccagtatctccagtttcaccagttacaagaagtacactacagttttattgtcagctagcacatggtagtccaacggcatttgtgtcaggtttttccaatataaaagaactttacgaacgaattggtgaatgcttcaaccttcctgcctcagatatactattttgcactctaaacacttacaaaattgatatgactaaattattaggagggcaaataggactggaagattttatttttgcacattgtagaggcaggccgaaagaagttgaactaacaaaatccgaaagtgccttaggtttaacgattacagacaatggtgcagggttcgcatttattaaaaggataaaagagaactcaatcattcaaaatattcctcatattaaagttggtgaccatgtagaaaagttagatggtgttaatatggttggtaaaagacattttgatgttgcaaaagcgttaaaggatattccagttgatactacatttgtcattaggctagttgaacctgtggaaagtggtttttcgtctattgctcccaaaagtaataaaccaagtggtgggaaaaagggatatggaagtggcaaagaaaccttacgattcaaagcggacggcaaagcagaaattcaagaacaggatgataccatggacattggaattgagaagattaatggaattttggaaacgtttctgggaatcaatgactcagaacttgcagcgcaaatatgggatctctctgtcgacaaacagaattccatggactttgcggaagctattgatgattcagaacttgccagttttatgttcacagacgaaatcgttattgaattgtggggagttatcacagacgcaagagataaaagactttaaattcattaataaaattatatatttataataaaattgacagctttatttttatatattaaatcttttatt

SEQ ID NO: 100 - DNA, 3599 bp, Diabrotica virgifera
  Annotation=CG6672
  SmartBlast Evalue=1E-102; Info=CG6672 n=12 Tax=Drosophila RepID= Q9VGS1_DROME
ctcctctgtgtttaggagccactatatgtaggggtacatctgcacggtaccatgtttctgcccatatgataatctgacgcgctcgagtaactgcaaaaatccccgcttgggctcccctaccataagtatttataatgatatagcaaataacagtagaccaaatactttcaaaatgttctgtatttccgtaggtctataattttcgagattatttctacacctttttatataatcgtccgtcattttcaatctagagatacaaaataattatttttcctcaactttaacaactgcatcacttttcacaacagcttcatctgggacttgactatcttctgcaggtgctacagttgtatctaacgtttctttttcttcgacaacttcgaccacctccggtgttatatcagttgctgcaacatccgacactgccacatcagttgctgtatcattagctgctacaacctctgttatttcaacgtcaggtgccacaacatcaactaccataggttcaggtttttcactagaagtattttctgtctctttagtttcaatcacactatctgcacttataacagtttcgaatttttctgtttgtacattatcaacattttcaggccacttctccactacgtctattgccatttccctgataccatctttattatattcatctaaattattttctcccatttgtaaagaagttcggctagttgtgatgatgctatctatcaattccgtattaatgttctcttcatctaattcctctgatttttcgactagttcagcattaagttcttcttcaattcgatccagctcctcttgcttcaaaacctgcaatgtttcttctacccaaggctcttttatttctgcgagaagcttatccacaaacactttaattttgtttatagtaaagattgatctgatttgtacgtttactattctatcgtcgaaaagagtcaatagtaatcctaaacattctctgtatatgaaaaaaaggactcctgtgaggtaccaatcgttagagttttcagctttggttccgtcataactaaatatgttttcgctgtagtgcgatcttaaagaatttaaggtttcccctgcatacaaagaaatattatctgtcttaaaatcatctatgcttttattcaatgacaagatatcttggaaagtcttttcctccaagagactttcaagcttcttcagtatacactttaacatccacaacatgttagctgctttattcttatcttcaactttctttagacttgcgagatactctttttcttctccaggaagcactgaaggttcaatcaactcgtttatgccaaaaatcggtacgtaccgatacaaatatctggtgtctcgttgaaacatcttaaagtaggggattatttgtgctgatgtccatgtcattccaaagtgtttgactatgagaggtagaattatagcagctgttcttctaacagcaaagacgtgatctcctagaaggcttccatagaagtgtttgatgttttctgcgaagtactcttttggagcaaacttaattatatgcataaatgtcaccaacaggccctttcttgttctccaatgtgattgagagtaaacgattaatgttcttataaccctcttgatagaagggagagattgatcaaagtctacatcatggaagtatggtgtttttacaatgtatttccttaaataaacggccggtttcggctgtgatttctaaagtataatttaagaaatatccacaacaaaacgtatttcacgagattttaatttttattagttaaatttattagattaattataattaccgtataaaaaaagacacgtagccaacagcttttgagtatattagttatggtgtatttttgttgaactaaataaacttatacatcagaaaaatgttaccgttatcacacaaggataaagcgtacccaagaggctttggttcaagaatcaaggaaaaagtaaatggttggattaggttaatattttcagacagaaactccagaaatttattcctcttccttatactgaacctgtctttcgcatttgtagaattaatttatggagtatggagtaatagtttaggtttaatttccgatgccttccacatgtttttcgactgcactggcctgcttgcaggactagcggcatctgttatcactaaatggaaagcgaacgacaggtactcttacggatatgtgagagccgaaattatagctggcttcgtgaacggactgttcttgctctttatttctttcttcttgatgtcggaggctgtcgagcgtgcgatcgaaccacctgaggtcaaacatgaaagactgtttgtcgtatcagtcctaggtttgttggtcaatttagtaggtatctacgccttccagcacggtcatggccattcccacggaggttcccacggccattcccacggaagatctaatcatggacattcccactccgtcaataaccatcaccattcccacgacatagaatttgacagcggcaattcacaaataatgaaaggagtcttcctacatattctagcagatactttaggtagtgtcggtgtaataatatccgctgtgcttatgagcttgttcggttggatgatcgcagaccccatctgctcaatgttcattgctatccttatagcacttagtgtcttggctttgataaaagattctgtaatgattcttatgcagaggcaaccggcagccctggataatgtcctaccgcaatgctatcaaaaagtggtcagtctggcgggagtctattctgttcaggaaccccatttctggaccctctgcagtgaagtctacgtgggcacaataaaactagaagtatctaagacggtggaccctaaatacgtagtttcgcacactcagatgattttcgcatcggtgggagtgaggcagttgtacgttcaattggactacactccaatgtgataaataagtaacacaaagtgataaccagccaatccgcgttaaggagaaaagctactaggaaaattaaaaacacgttttcaattttgttatcgtagagattaaattttatataaattttttatatcagtttttgtttaaccagcttccggacgtgtcattcctaacggaaagaactttgctaactaagcgctaacgcagacagggcggcgtacgtcgaaagcgatccttgtttaacgttacttatatggagtgacacacgacacacgccaggcactctcgaccttttcgttgaatcgacggcctctcgacccatgcttcaaaccatgtgtcgctagtcggttttacaacatacgacggcatatatcatgaatgcgcatatcgtgcttcaacacagacgattgaacggttctccggcgatttttgttgtgagtgttgccaaattttgttaatgctggaaattacagacttaaacactattttaacttgaattgaatttaaacagaagtttgaattttcaaacctgtaaccattgaccagtttgacttgactagaattatttgtcagaaggattgatttcaataaaaataaaattattgactccataaaaataaagataataaacagttatcttaccttattcattat

SEQ ID NO: 101 - DNA, 648 bp, Diabrotica virgifera
  Annotation=DDB1- and CUL4-associated factor 7
  SmartBlast Evalue=2E-94; Info=DDB1- and CUL4-associated factor 7 n=19 Tax=Deuterostomia RepID=DCAF7_HUMAN
tcctgctcgtgaaaatgcaatgtcataaacttctttatcgtgggctataagctgggtttttacatggcctgacactaggttcactctacccattacttggccagtttcaagtccccaaatagtacaagttgtgtcaatggaagatgtaccaactaagtttggatctacttcattccaatcgaaactagttaatggtgcacaaaaatcggaatttttattattgtttaagacacactctagtcttgtgtctggctctcctgctctccaaaccctcaaataatctccactagttgccaagagatcaggaaaaattcctttactgtcgggtatccacatgattttagtggttggatatggatgatcaaaggtgctttttgcagaaaactcgctactgtcttcatctaatgaaactacttgaactttgttgttatactcttctacaaaacttccaagagccagccgaaaccttttgtcaggtcgtacagaccagttcatactataaagaggccatggggctatatatttgtaaatttctttacgttttcccccagggacaacccctgaatgggccatttttgaaaatacttggtttctggaatgtatttgaaattcttgttatttataaaactaatattatttgtttataat

SEQ ID NO: 102 - DNA, 785 bp, Diabrotica virgifera
  Annotation=Deoxyhypusine synthase
  SmartBlast Evalue=1E-92; Info=Deoxyhypusine synthase n=1 Tax= Culex quinquefasciatus RepID=B0W851_CULQU
gaaagaatgcataaacatcatatcaccaagactaccatcagtcaatgcagggcaaaacacaggaatcttattcttggctgcccaataataaacactatcttcatgattaatttcttttcctagcctttctataattttactgggagtccacagcacaccatccttttgttctttcaacaactcatctaaaattggtaaaatccaattttcaaaactacaataattgtcatttggcactaataagttcccaatcctgttaatgccgcattctcttagagttttgccatctaaatggaagtcgcctacaaaagtaggagcgagacacttaatgagatcttcttcaacaccaccagcagtggtcactatacagtctaccattttttgcttaactaaaaacttaatagtttctcttaatccactagatattaaattagaagtatatcctaaaaatattgtacaactattcttaacaactgtaaattcatcgtcattatccacaaacttttcttcgggaattggctgctttctacactccaacattttattaacttcttcaacagctagaccaaaatttgtagcttgaaatccactttttaggtaactttgcagaagtttatcataatgtaatccttcattccagttatatccagacaccctgtcattcaaaaaggaaagatttgttgtcttttttaaaacagcttcattcagctctagcattaacgaatttgccatttttcttataaattaatttaattatttaaaaaaacaactacactaatttattg

SEQ ID NO: 103 - DNA, 1117 bp, Diabrotica virgifera
  Annotation=Ubiquitin domain-containing protein UBFD1
  SmartBlast Evalue=3E-79; Info=Ubiquitin domain-containing protein UBFD1 n=1 Tax=Camponotus floridanus RepID=E2ABK8_9HYME
tacaataatttgtagtagaacgaaatttgttggtttcagagacactcaatatattcacattgcaagtatttttcgaataccacttggacatacgatttctcacacttaattgtttcacttgtgaatcagaagtactgccattttccgagtacggcgtccttgatagcatctatgtactgggctggtacccaatatatccaataccgtgatgcttctgtaggtcctagctgtaaacccagtatatgatattcatcatgttcttcaattggttcggatatcacacttttaattgaccccataggtaatttttcagtcctctctttagtacttaaccataactggtcactttctaatttaaatgttaacctaacttttcccccgtgcttattaagcattcccgataaaggtactggcggtaatccctccttaatattttttaatccaggcatgacgtcttctggtaatcctttgtctaacactttacggtgaattttttgtttacttaggggctcctttgatgtagtggccttttcaagttcgactacatcctgtttggtgacagatgaaacagctaagacatcatttaaagtagaacctaccaacataatttttgagccttttgtgataccagaattagaaatagtttgagtatcttgcaaaagtcctttatacataagtttctgcattgcatctggaacgcctaataaatcttgtaaatgcttttttagttctaagattgtggtattggaagttgttgtgatatcattacttttttttgttatatatcactttaatttcaacaggatcacttttttctaccaaatcgttctccttactttccacagcctctacgggatttgctacagtattttctttgacatcagttttaggaattttagattcagacggctctgttagtctatcatcttcttctttagtatttgttacttcaacactatttaagtgcttttcttctccgtttttattttccgggtctagacattccattttacaaaatatatcgttggctacaatcagaataagattatttaaattaaactgttttctttgaataagattacttgcatttcaaccatctgactttgaagttgacagt

SEQ ID NO: 104 - DNA, 889 bp, Diabrotica virgifera
  Annotation=Sorting nexin-4
  SmartBlast Evalue=9E-87; Info=Sorting nexin-4 n=2 Tax= Formicidae RepID=E2ADZ0_9HYME
tttagatatcctaataaggttaagtacaatcaaaccaaagactgaaatattatgaaaattatgtacctattgctgaatttcatataatattgataaaacatacaataagaatatgaatatataacattttcgaaaacgtaggtattaaaattagattctaaaaatgagcgatacagaagataaacaagaaaacaccgaacctaagccttctggaaccttactaaatcacttggaaatttcggtgtctgaatctgagaagcgtgtcactggttccttgaatttacgagatcattatactgtgtacctaatcgaaataaaagttactgatccagaatttcagaagaaagtcggcaaattgaccacagtatggagaagatatacggaattcgaacaacttcatgattatttagaagttacttatccatatttagttatacctcctcttcccgagaaaagagttttatatggctggcaaaaaatctctaatgatacatttgatccaaattttgtggatagaagaagagcaggattagaaaatttcttgctcagaattgctgcacatcccttattaacatgggacaaacatttcctagagtttttacaacacgaggaggattggagagagtcatataaagcaaatggatatttgcaattagtagaaaataagttaaaaagtctcagcgtgtcagtacgacttaaaaaacccgatccagaatttgaatctatgaaggaatatggatcaactttagctagtaaccttaacaatcttcttaaagctcgttctagagttgcggaaaaacaatacaatgtccataaactgcatgcgaactacggaagagtatttagcgaatggagtgctatagaaaaggaaatgggagatgctctgcag

SEQ ID NO: 105 - DNA, 1155 bp, Diabrotica virgifera
  Annotation=Probable GDP-mannose 4,6 dehydratase
  SmartBlast Evalue=1E-76; Info=Probable GDP-mannose 4,6 dehydratase n=1 Tax=Camponotus floridanus RepID=E2AAP5_9HYME
gtccctgcatttgtcttgttttcttcttttatttattgacagcacaatattcggaagatttgaagattagaaaacggaagaaaaagatttgtttacctgctgaggccctaggccgtcaatatttttgggaaattatcaaggaaaaataaaaaattcaacccctcaaatagcagtgaagagtgaatgatgtgtttggatttccaaaatgttaaagtgtttttatggattttaattttcaaagtaatactcatacagtcgaaaacgtcattgtggaaattaaatattgataaaacgaaaattatcaaagttacgaaatttccgtctataatttcgtattcggataatcaaccgatttttcattcgggggatcctttgtttgatattattttatccactgaacattatggggagacatgggtcaaacagcccattcagtattattgttcagattgtaaaaacagaagaaatggaacaaacccgaactcataccaaaagtatcaaacagccgatgaggttttagactgtgggaaacctgtcaattttacgtattttgacaatttagtaggtgttgtgaacagaaacaaacaccccacagttcccgaaccgcaggcaattttatgctttaccaagaattatgggaactacaagagtgaaatggaagagtttgatattgatgctcttgaaaaaagactgaaaaaagccaaaaaggagaagccgagatctattcaattatacaaccagatcggcaatttttggcgtattaaaggagacgccaacaaagctatcgagtgcttccgtagagcgctagcagtatcgcctcataatgcagaagtcctgctcaatctcgctaggatactgttctctttacaatatttagatgatgcgatctatctaaccaggaggtcgctggaagttcagccaccagataaaggtgcttggcaacagtattttacacttggagaaattttcaaagcttatgggcattatcaagaggcttccatacacttaaggcacacattagagctcaatccagattttgaacctgcccagatagctctaaaagagatggagactatgcctgccgctacaatccacatttatactcttgtgatcattgtctgtttggtgctgggcgttttgttggttatattatcc

SEQ ID NO: 106 - DNA, 883 bp, Diabrotica virgifera
  Annotation=Lethal s1921
  SmartBlast Evalue=3E-98; Info=Lethal s1921 n=1 Tax=Bombyx mori RepID=B5TJK7_BOMMO
actctctttaaccactctcttgggatcctccaaatacttagttaatatttcagtacattcttcagtagctatagcacccaaagcctctgcacattcatgacgaaccatttcattttcaagactatcctctaaagactgcctaagatattttgtggctctttcatcttgtaattgccccaaaacaaaagcaatttcatgtttgaataaggcactcccgtgttgcaaagctgttcctaacgcatctatagattcagtagtttgtaaatttcgtaaagaaaacatagctcggtatctttcaaaaagactggcattttcatctagtaagaccttcttcaatgctggaacatcagtatcttggcaaggaggtgcaggatccactgaattataagggttcgctgaaagtttttcatcctgtttttgagactgcaaccattttattctgtccaacgccagctggcaggtctctgctacttctaccactggatcatttttatatttctcaagaatttttatattttctatacttccaatagctcccagggcttcacctgcttcatgtctaaccataggttcttgttttacatcttccaaaatttgggtgagtattggattggctttttcatcttgcatttgacccaaacagtatgctaattcatgttttaataatactgatgaatccgagaagcaggaggcaatacactgaatggatatttcacctccgatgtttcttagtgtaaataaagcacggaatctttctttcaaaggtctcgacgagtcatttaaaacctttccaatgtttctgatctgattttcattaacgttaaccattctattactttaaaattacaaaaacaattacacataaaacagtctgtttgacgtt

SEQ ID NO: 107 - DNA, 1033 bp, Diabrotica virgifera
  Annotation=Cytochrome c-type heme lyase
  SmartBlast Evalue=3E-95; Info=Cytochrome c-type heme lyase n=1 Tax=Camponotus floridanus RepID=E2AJS4_9HYME
gctaacttcatgtcgttcttgacatttttgcatttttatgaattttagatcgagtcaaaatatattaaaatacataaataaataattattctaataactcatgatccaataaaattgtaaaaaaatgggaaattcagtctctgcggctgaaatagccaaagtaactgcatcgcagttaataaatgcaaatgatcctgtagaagtagaaaaacatcgccagaaatatcagaattacactggagaaataccgccagaatgtcccatgcaccaaaaggtacaacaaaaacaagtggaatctggttgtccagtacagggcaatgacgatataaatcccttaaacatgatgggaccagccaatcaaaagccatcaccaggacaaccctttcccttatccactgatcgccaggtttcaacaatacctaaagctataataaaagaaggagaaggacacttttgggtatatcctagtccacagatgttttggaatgccatgctgagaaaaggttggaaatggagagatgaggatattaagcaaggagatatggacaacataataaaaattcacaatgccaataacgaacaagcttggcaagaagttttaaaatgggaggcgctacatgctaatgaatgtcgagatccgagactgaaaagctttggcggtaaagcacaagactacagtcccagagctagaattcgtcatcttttgggatacgaattacccttcgacagacacgactggattgttgacaggtgcggaaaagacgtccgatatgtcattgactattacgatggaggagattgtgatgacaaatacagatttgctctgttggatgttcggccggctatggacagctttgacaacgtttgggacagaatgaaggtgtgctggtggcgatggttctacagcgatgaatagatacagttagctgcaggcagtcgtatcactacaattctgtagaagaaggaaattgttcgtgtcaaccacattttgaaaatgttctagagttgatttgttgcaaaaagctcgttatta

SEQ ID NO: 108 - DNA, 807 bp, Diabrotica virgifera
  misc_feature (19)..(21): n is a, c, g, or t
  Annotation=Vesicle-trafficking protein SEC22b
  SmartBlast Evalue=1E-94; Info=Vesicle-trafficking protein SEC22b n=1 Tax=Camponotus floridanus RepID=E2AEM8_9HYME
aaaaaatattttaaaaatnnnaaccgcccattgccggagaatatgaataggtatggagagtttttttacttggtgaagctttacaaaatccagaagtataaaatgaaggaaagaaagactagtccgcctacagctgccgttacgtacatcgattttgtgttcaagtatgtcgaatccttcttgtatttgtccgttaacatggatagattctgcgttttggtgtccaactctgatagaacagttcctcgctgcagcacatcatctatattttgtaccataatcctttggacatcgtgtagctgattatttatcacatttaaattccttctcgatctcgaatctgcaaactgttttttggctttctggatatatgtgtcaaactctatgaatgtataaggcctagttactgtattcactcttttgccatattgtgcgtggaattcttgtgctatatcttccaaatatgagtaagccagtcgttttgagaaagccttttcacataatactaggtaacaaacttcgtattctattaaataatggaatatataaggtcccgtttcaattgaacatctagcaggggactggtgccccaattttcgaaataacattttcgcctgattctggtagtccaaaatatttcttccagactgttcgtcctcttgcattgtggctgcaaggggcaaaccatctgccactcgggcaatcattgtcatcaaaaccattttttattaattgtaaaaacacactttttgattttaaatgacaaatcttgctgttgagtgttgggtaggttattttatttacacg

SEQ ID NO: 109 - DNA, 889 bp, Diabrotica virgifera
  Annotation=Vacuolar-sorting protein SNF8
  SmartBlast Evalue=2E-96; Info=Vacuolar-sorting protein SNF8 n=3 Tax=Aculeata RepID=E2AZJ8_9HYME
actgactctaactgtagtttatttcatacaaaagtctagtataaattaaacatgctgctttttattaaaattgtggacaaaaaatataaaaataaagatttataactgtaatttaagtggtcaagcatttgagtttatacaggcagtgtacagactaggaaagtagtattgaggttcttcaggatgttgtgaatcaatccaggccaatccttgattaatcatatgttctaaagccttttctgctctttgcctttcccagtttagttcattggttaaatgtgatgcagatacacaagctttatttttctccgcttgctgaagtaagactgaatgatccatgttaagttcgccaggtacagattgaaccatatatctatcttttcccatgggtataacattaaatccatttccaaatattttcaatttacgtgcagctcttattaaatcgtcttttgtaatttcttgatgtgctttactttgacctcgagctttgattaatcttgttcttagctcatctaaacttattaggcctccgttctttgctgttgtagacaaacagacttctacgatttgtactgctaattcataataaaaatctcctatgcctaatacagaccagaaacctttccctgatgataatggatctacaccaatactggcacacatttcctgaaattgcttcctaaattctggattttttcttatttcattcttgtgtttagtggcaaaatcttctagatttgtcttgaaaacttccatttgtttggtcatttgcccaaactgactctcttgaatttcatttcctttgcctcggtatcgttcttgttctaatttttcttttctaattgctcctacacctattcctctccgcattttgattagattcttt

SEQ ID NO: 110 - DNA, 762 bp, Diabrotica virgifera
  Annotation=Protein rogdi
  SmartBlast Evalue=4E-80; Info=Protein rogdi n=4 Tax=Apocrita RepID=E1ZV53_9HYME
gtactgaacactcggcaggagtagagtcgggcgtcataacgccctgattgttcatcaaatggtacataacaaataccaatttgtggctttggatataaaaacttattgctagatcttctgctaaaggcggggcaagcgatttcatattgcgactcttaagtagatcgtatattgtcttctttctaggtactattaaacttgttcgtcctctctgcaagctacctaatatatttcctaatacgtgaaggacttcgtctgaagatttaaatttgtagttctttcctacatcatctatatgatatatggcctgttgcaaatgatttgctgcatcttgcacttgttgcagtttccatgggtattcactttgaatggtagtgcgtaccattgtggtatttgtctgtcttacaactttaaaattaatatctgcatgtgtaatgctgtctcctgttagtgtgacaacacattttaattggtcagcaggcactgacaaaacaaatttgtcctgtttcgaagaattatcgtgtccatataaagcaactggaaacctcctagcacactccacaagtatttgatgaatttgttcgagacctttatgaacctcttgatttaagacccattcgaattccttttgcaaatttgttgcttcttccttctcacagtcggtcattgtttgtattttggatatattttctttgctatatagtttttaaatccatctaataattgcttctaggagaattttccgatgcacctctacaacta

SEQ ID NO: 111 - DNA, 1010 bp, Diabrotica virgifera
  misc_feature (21)..(21): n is a, c, g, or t
  Annotation=Probable GDP-fucose transporter
  SmartBlast Evalue=5E-83; Info=Probable GDP-fucose transporter n= 1 Tax=Camponotus floridanus RepID=E2B0K8_9HYME
aatgatgttcgagctccaccncaaaaatgactttgtctcttggtaccataagtggccagcactgtttgagcgcaggctttagcagtaccggatatattatgtgtgagtgctgatgtatattttatttgcattgtggtaaaaaatccaatggtaaatccacatagtccacctgctacaacgatagaccaaaagtatgggctgccgaaattagtatagtttacagctccttaatttcattgtttaatatcattacaggcaaaagaagaatactggcgtatacattattaacatatgataatgcccaaacttctccgtttagttttggcaaaactttttttgtaaaaattgagaataatgaaagagatagtgagcccaggattccaaaaacaaatcctggtatcgataggctccctgcaagattttcttgatctactcctagccaaaatccagaaatgatcactgcgcaacaagctatacaacttttagaagtggtctctcccaatattagaaatgtaaacataacattaaatatggtagttaatgatcttcctatataatagtaagcaacagatgcatattttagacacaaattgttggtgcagatcattgttgtaaacaagagtgacaaaggcatgactgttttaacagtatgcttgtcccatacatctacatctggaaatttgaacttattggggtaaacatcactcagacttttcttaaaataacaaataacagctgtaatgagtgtctgtgtaaaatttataaacataggggcatctaaattaatattacttaataatgtcttattcacaaaaacagttgtaattgaaactatccaatatccactaacaactaagaatattgttacatattttgataaaagactgttttccatgaccatcttgctgctgagaattgagcctcggttagactcactttatcagatacctttagaatactttaattcttacaaatattttacttttacatgtttaatcaacaattttaac

SEQ ID NO: 112 - DNA, 1054 bp, Diabrotica virgifera
  Annotation=Slc39a9-prov protein
  SmartBlast Evalue=2E-80; Info=Slc39a9-prov protein n=2 Tax= Culicini RepID=B0XGK8_CULQU
tggagcctatgaaaaaggaacttagtggtgatggcctatcgacagcaacaacggacacatgcatcccacaacgaggaagagtaattctacagattttaatcgagaactgggcgagggcagtttagagttctccgattgcggcagtctgtcgtagctgtgttcgtggccttgcgttatatccgctaaaacgtggacggttgctacgtacaggaaggttcccgccgaaaacaacatcgctatacctgtcgcattcagtgaactaagagtctctttttgcttctgtcctattccgaaatacgtcaaacatgttaggacgggagcagctaatgaaaatatcaacaaatgtttacgtatcctctgcctctcgattccttcgtgaagaagaaaagtgacgagaccgaaggcagcaggcgccttgtgtaacattattgctaggaatacgattatttctacgtccgcatgactagtcgtagctgctgcaccgagcgccactccatccgcagctgcgtgcaccaccaatccgacggtagcggtaatgttcctttcggatggattgacgttttcgtttcgactttgggatatctgatccactagcagcataaatataaatcccaaaactaaactaataccgattactgataagggatccttatggtcttcggtatgaggttcactagaggccccatgtccatgagattcttgtggaatcaacgatcttacaccttctggaatgataacagctagtgctgtgcccactagaagaccagctccaaatacacttatcttttttaatttgtcctctgaaaatgtaaaaaataatgggatagatcctgctagaaaggacccaactagcataacaaataccagtgccaacaacacagctgtttcttccatttcttgccgtttataactagaacacggtggagttaaatgtttattttaatatttaggcattgtttgtaatgtgtacataaaaaatgcgtgcgtatcacaacaaaatactacaacaaacattaactaaattttaaaattataactttacacgtatcctgca

SEQ ID NO: 113 - DNA, 643 bp, Diabrotica virgifera
  Annotation=Cysteine desulfurylase
  SmartBlast Evalue=6E-96; Info=Cysteine desulfurylase n=1 Tax= Aedes aegypti RepID=Q16S16_AEDAE
attatatcactagaagaattggaacaggctatgactccacaaacatcactagtttccataatgacagtaaacaatgaaataggtgtaaaacaaccaatggatgctataggagcactgtgtaagcagaagaaaatctttttccatacagatgctgcacaagccgttggtaaaattcctctagatgtaaacgctatgaatattgatcttatgtccattagtggacataaaatatatggccctaaaggtattggtgctatttatatccggcgtcgtccccgtgtaagggtagaagccctgcaaagtggcggtggtcaagaaagaggcatacggagcggcacagttccagcacccctagctgtaggatttggcgaagcttgtagattggcaaaagaagaaatggcttacgatcacgactacgttgaaaaattgagtaaacgattaatagaccagatatccagttctttaagtcatgtaattagaaatggagatgaagtaaatacttatccaggttgtgtgaatttatctttcgcatatgttgaaggcgaatctctactaatggccctgaaagacgtagccctatctagcggatcagcgtgcacttcagcgtctctggaaccgtcttacgtcctacgtgcgatcggaa

SEQ ID NO: 114 - DNA, 1705 bp, Diabrotica virgifera
  Annotation=ZIP Zinc transporter; Pfam: PF02535
atttatgtcatgattgcgctattgatgtttttatcttcagatctgactttattgtcatctaacttttcacttgcattttcgactttgacatattcctcgatagagtttgctaaatttttttcgaactcaaccagcgaaggagtaagcgaagattcattgctatcaatatgtcttggtacagtattttcgttcttgtctttgatttgtttatcggccatgctgaatttttctaagatttttattaaacttgagtgttcaattttactgtcttcttcttttggtacgtggctgataggttttctcataacaggttcttgtatgggagatgacggaggtgtgatactgtgcggctgagtagctggagtatttgtggatttgatcagttcgttatttcttttacatgcttcttctgcagcttctctgttaatctttttgacgagagactcagctcgtctaggcttgggtttaggagttaatttttctatttcttcttctgttacgatcatgccttctaggcctgctaatacggaatcatcattaacaactggtttccttggtcttggtaaactagcatcttttggattataatgttcaattagtcctaagtcccagtcttctaaaccaccaaaggaatcatcgctttcaatatctgttggtgcttttcgcggacgtaatttcttcagttgctgtgggaaaatggatccaaaacttcggcatcttgttatgtacgtatccaactttcccgtagagcctgttgcagtctttttgtggtctactggtagagatatttctgaaggatgaccttttttgtccgtctttagagaggatggccctttattatcatctttaaattcggaaacagtcaacttcaattcatcgtaattaggaagcgaatacactgataaagtctttttccttttcaagctctcttttccgtctcttaaattaataaacttgtccgttttgttatcatttttatcgtttacatggttatgttcatggtggtggtgatgatgatggtccctattgaaactggcttcatcggcatcgcaaatcggacatctgtagtctatggtctttttgacaaacagtggttcttctacttctgttggtggtttcggaggagtagcttctacttgcgatttctttgactgaaaggcttgcagtccagtttttgctactgcttcgattttctctcttaaattcttcttgtgttttcttggaggaggcgtgggtgttcctttatcgttattaaaaatgagattaagttttggattgtgaaggtgaatcggatggtcctcgttatcaggtacttccagatcaacttcagtccagtcggaggatttcgaaaggggttttgtggttattacattgttttgtttttcgtttggaatcttttccaatcttttgacttgtttctggttcagctgcggatccgatttccaggaattaggtcgaatgtggaatctgttgatgatcctgtcgaactgagagggtgatttgctagcgttatccacagcatcctgcgatttcttcttgcacaatttattccccatttcggacacaagtaactagcacagaacaaaacaaaacaaaaatcacggtcggccgcggtattgcgtagcgaccaaaacaaaacagtcgaagtcggctttgaattcggcctcgcacactggctatcgagtggccgcgtagtcgaccttag

SEQ ID NO: 115 - DNA, 990 bp, Diabrotica virgifera
  Annotation=AN1-type zinc finger protein, putative
  SmartBlast Evalue=1E-53; Info=AN1-type zinc finger protein, putative n=1 Tax=Pediculus humanus corporis RepID=E0VUR2_PEDHC
tatcctcttttgtgaaaagtctcaatttcttctcatttgctttgttattgttgttctgcaatttcatttcttcagctatagcatcgattgctcttccaagactccactggctggaaacaaacacaggacaagacttttcacaataggatacactgaaatatacacgatcaacggttggaattgttttaagacctgtagctttattttttatcttcataagctgcactttgttcgccatctctctgttttttggtttctttttcgcatcagctagatttttttctacctgtttgtcaacaactgctttagcttcattaaaaatccttacaggagctgcatacttctctttttctttgttcaaagtttcttcatctttttctttgcactctgccaagtgtctatgttgaacacaaaagtgttgcttacatctttcacatattagagctacaatactccgttctttacagtgaggatgagaacaaatataaacgttttctattttctttagttcatcctcagagagaaattttgaaacttcacattcttgcgcatggattgtaaaatggtctgaacaaaaggtttttccacacttacaatttaaaggaaggaaatcaagttgtttgcattgtggatgtgcacattgcttgccgatatctggcaattccattatatctaaacttataaaattagtgtaatgattatattccaaactattattgatgctcgctaagatgagacagcataatatcactccacttctgttcttgttctttcaaagtcagatgaatgtctcctgaatcagcttctggatctgctagttcccaggttggtactgcaatgtcgtcttctggaagggtatctgatctccaggcgtcgtctattaaatcaacaaagtatccttcgattgctacttggctgtccatcttacattcaattcaaaattcaatattttttcaaactgtcaaaccctgtttgtttgtcatccttctc

SEQ ID NO: 116 - DNA, 1293 bp, Diabrotica virgifera
  Annotation=Blastoderm specific protein 25D, putative
  SmartBlast Evalue=6E-47; Info=Blastoderm specific protein 25D, putative n=1 Tax=Aedes aegypti RepID=Q174W5_AEDAE
tcgggtatgtgaaagtggtctctagaaataaaaaaaaccgcgactggttagttacatgacgggtttccattcaagtgttgtgtgtttattgacttctttctttaaatacatacaacaacaacggtgataattcctgtaattattattcaagtgtatttataattgtgagcgatcaaaagtgtaaaaataaaacgtcggtagtggattgcgtctaataggaggcatcgttttttcgggagcgtccagcgatgaatggaaccattatcagtcgaaaattaacgtgatacggtgcacatctagttttcccgcgtgacaaatgaaattttcgaggtttttctctaaaatggcggacaccgagaacgaggaaaaagaaaatggactcgagaccgaggatgacttggacttcgacatgtggtacgggcagtttgagtttgttggaaataatgtgaaagactttaaagccaaagatttcaaaagtaatggagttatgggattgcatcgtcataattcggatagtgactctgatgattcgtttcaggtgttacagcaacaggtaggatatcttcaagacacagccaaccaaaatgatgagaggtatacgagagccaaagcagataatgcagctctccaagctagggttattatgttagaagaacaacttagggaaactgaaatgagaagcgaggagaaattacaggatgaacgtaggggattcaaggaccaaaaagctagattagaaagagaaaaacaactattgttggataatgtgaatctaagactgcaggcgtcggaaacagaatgtgcaaatttaaagaaagagattaacagacagaaagacgagattgataaatataagaatgaaagacagaatctaatggatcaggtttcggatctcacaagtgaggtgactagtgtaaaggaagaaatgaaaatgatgaaaagccaagaaattaggttaaaacgtgaatatgaagctcaagtacaactctcagaagacttgtcgaaagaaatagaaagattaagactggaagccagaaccccggcccttccgaccacttctcccgaaactttgaggttagaagagttacatgaagaaatgacgaatttaaggtcagaaaattcagagttaagagaagttaacgaggaactacaagccagtttattacatgcaggtttagaaaccggtaggatcctttcgataggtgaaaatagtttggcagctgaattagatgtgatgtcgcaagatgaggttcaaaaagcgttgaaagagcaacaagaagtgaaccggcagtt

SEQ ID NO: 117 - DNA, 689 bp, Diabrotica virgifera
  Annotation=Eukaryotic initiation factor 4E
  SmartBlast Evalue=4E-93; Info=Eukaryotic initiation factor 4E n= 1 Tax=Tribolium castaneum RepID=D6X3F1_TRICA
gatcttgcagtgacattagagtcgtaatttcaaatagtttactatttataaattaaaaagaatacagctgtgataaaaagtttcatggtatttaacattaataaatctgcttcaaacatgtcaaacaaattcgaaacattgaaacaccatgtggacgacgacagtggaagtggagacgaagattcaggcccaaatatcacagatttgggccccattgactatcctccaggagaacacaggctgcaacatccctattgtttatggttttcaaagagacctcaacaaatacaagggttgcagggatatagtcaagcactgaggttggtagggcaggtgggcacagttgaacaatggtgggcgttgtattcgcatatggttagactacaagacatacctgcccacagagacatacatctttttaaaaaaggtataaaacctatgtgggaagatgcagccaataaaaaaggaggcaaatgggttataagacttaggaaagaacaagcaggaagggcttgggagaacttatgtatggctatgttaggagaacagtttatggctggtaatgaaatatgtggagtagttgtatcaacgcgatatcaggaatacctcctaagtatttggaatcggacggcttcagatcaagcaaccacagctagaataagagatgccttaaaacgactgttaaatat

SEQ ID NO: 118 - DNA, 1497 bp, Diabrotica virgifera
  Annotation=Lysophospholipase
  SmartBlast Evalue=1E-80; Info=Lysophospholipase n=1 Tax= Glossina morsitans morsitans RepID=D3TN81_GLOMM
ctgacacctaatcagctttaaaaacccaatttttcgcaattttttcaataagagattatcttataaacactataattttaaatgtactgataaccagaggtcagttgtagtagaaccttaaacatggcagccccagtagtcattgctgcgaccacgaaacacacaggaacactaattttcttacatggattaggagacactgggcaaggatgggcaagtgctatggctgcggtgagacctcctcatgtaaaagtaatttgtcctacagcccctacaatacaagtcactttgaatgcaggttttcgcatgccaagttggtttgatctgaaatcactagacgaatcaggacctgaagatgaaccaggtattaaagctgcaacaaaacaaatccattctttgattgaaactgaagtaaatgcaggaatcagtgtagacaggattattttggggggattttctcaaggaggagcccttgcgttgtactctgctcttacttatcctaaaaagattgctggggttgcagctctatcatgttggttgcctttaaataaatctttcccagcagctaagaaaacagaagacactttaccaatattgcagtgccacggcgactgtgatccagtagtcccttacaagtggggccaaatgaccgcatctgtattaaagaacatgcttaaagacgtcgaattcaaatcatacaggggcttgtcacattcttcttcggacgaagaacttaacgacattaagcaatttataaccaaaaacctacctagtcaatagatgattctttgtgaaactatttgtgttccttacatacttcttattcaattcccattaaggggggttcgaaaatatattggtaaatagggcgaattcaattttaaaaaaaaaatgtaattgaatattatatacatagtgataaaaagtatttgtaaaatatgactagatatgattaaatcttcaattgctatgtacaaaattatttattacctgtttaattcatacacaaacatgactatcgataagaaaaccataaatcattgtcggaataatgttagacagtcaatacaactgtttctcacttattatcacgtttaaaatgatacactagaaattatttttttagaagaaaagtaattataatcacttagagcgatgtctgggttatctcatggacattttaatattttaaaccttgttggcatatgtcaatttgttggaatttagttaaaagaccttttccaatgaaattactggtactatgtcttatttttatacgactaatgtgaccatggtgaatgtttattgcagaaaatactatacttagttaatgaaatgcattcagatattattaaacacagtagctctgtcagatacatggactgtatgtcttgcatgttttggtcttaattccttttctctttactagtagtgaatttatgactcctaatgcaaattctttacttattcaggaaccatggttctaacatacacgcc

SEQ ID NO: 119 - DNA, 1042 bp, Diabrotica virgifera
  Annotation=Protein Red
  SmartBlast Evalue=2E-71; Info=Protein Red n=2 Tax=Aculeata RepID=E2BWP8_9HYME
atactctttcaggttttctggcatacccttcctgttcttctttttacgatttccctgtcttaaatagcttaatatctgtgtaagtttattaataacaatatcatttgttgttactgtagtagtcaattcaaacgaaggaacatctgcaatggatcttattaaagtggttggaatatcactttcagcttcatcctccaagtcaataacataagccattctaccaggaataaacaattctgatctttcaatatgtctcgacttcaacatattcatggtataataaattgatcttccaatttttgttttaaatttcatttcttcctcctctttttctgggcatcttttttctccttttctttttcttccaagtgtttattagcaagttttttccagttcttgttcctgctccatttcaagtgtttgaatttcacttctgactttttggagtagagcataatccaatccttttactaaatgagtatgctccatgtcacctcccaagaactttgactcttgaatcatctgccttcttcgttccgctgcatcatatccagacttcaggtctggcgctactgctcgatatgcttgagcagtagcaattggatcatctgcttgatagtcaggattgtgtcctgatcttctttcgcttgctctatcacgatacttttcagcaagttctgccattttactatcttcttgttttttgagtttggcataatagcttttctttttacgtctggcttctgatttgtcttcaattttaggaggtggcatggagttgggattattcattgcctcttttattgaacctggggccgcaggtgtctgagaagggtttgatctaggagtcatcagaagctttcgaaaatcatcgttagtgagacgttgtgacattggtgtttcagccatttttcaagtgtatattgggtctacgtaaaaggtaaactaatttaaaacttggtttatattttaacaaataggtagaaaattagtcaatattttctatttatgaagcacgaacttcacatttatgtcatgtgac

SEQ ID NO: 120 - DNA, 763 bp, Diabrotica virgifera
  Annotation=ATP-dependent RNA helicase SUV3, mitochondrial
  SmartBlast Evalue=6E-74; Info=ATP-dependent RNA helicase SUV3, mitochondrial n=2 Tax=Culicini RepID=B0WAJ5_CULQU
attttgaaatgtttttctattaaaaatttggtacagtgtttgttttagatttttttacaatgttacagaatactagtaaagttagaaatctgtgtgccacagtacgggggctaaaactttccaaattatttaaagataacgacgcaaaatgtgtacttggctatttacaaactagacacaagaaagatgattccagtttatcgtctttatttgttcctgttcaaattaaaccgagtgcagatgacataaatgttggagcagaacttacaggaactttgaacaaaacagatttgttaaaagttttgaataagttttatcagaaaaaagaaattaaggcattgctagtagataatggattagatcagtaccttcagcaccaagcctatgtgagtttccgaagatattgcctagaagcacaaaatttaccagcagatatccacgtagtcttcagtgacattctacagggagctggaaatatcactgatattttcccctactttctacgacatgccaaaatgatgtttccccatctcgactgcatggatgatcttagaaaaatttctgatttaagatcacctgctaactggtatcctgaagcaagggctattaacagaaaataattttcattccggacctaccaattctggaaaaacataccatgctttagaaaggtttatgacatcaaaatctggagtatattgtgggcctttaaaacttctagccagtgaagtgtttaacaaatcaaataacagagggacaccat

SEQ ID NO: 121 - DNA, 545 bp, Diabrotica virgifera
  Annotation=Vacuolar protein sorting-associated protein 11-like protein
  SmartBlast Evalue=5E-72; Info=Vacuolar protein sorting- associated protein 11-like protein n=1 Tax=Camponotus floridanus RepID=E1ZWD6_9HYME
ttcaataacttcagtatatttttggtggtcttcgatttgaagttttatgtaccaatcatgtttatcgtgtttcttagccaacatgagtgcttcagctggactcccctgtctgcatactttaatggcaacatccacatcgtaattaaaatctccatcttttgacaaaataaactctttcaagctatcggattggccgacagagttatttagtttggtgtaacaatttagcaaaagcgtggtatgatcttctgttgcgtgaccttgtttatgtaaagcattcaaatacatcgtaagcttttctatatgttgagaatccaaaaattttcggattacgtagctcggttctagctttccaatagtctttatgtattgctcaatggcaccagaaaaatcacttttttcacacaaatgatccccatattgcttgaatatattaaccaaaccatcggtatcgtattgttgactctttgcaatcctaattgcaatatcatataaattcttcttaaacagcagtgacaactttgactgcaaatctttttcatcca

SEQ ID NO: 122 - DNA, 991 bp, Diabrotica virgifera
  Annotation=Alpha-1,3-mannosyltransferase
  SmartBlast Evalue=1E-57; Info=Alpha-1,3-mannosyltransferase n=1 Tax=Aedes aegypti RepID=Q16NB8_AEDAE
gtcgagagattgtgcattatccgcataatcctataaatcctgtatattgtgtattgtatgaatcatgatgtcatcattatcatgatcattatcagttaacaacagagcaaagactaaagaggaacagctgtttagtacaaagttaaccttacatttgcattttacccacaacaatgtttttgtataattgctacaaattataattaatgtatatagagaattaatctacaacagcattccatagcagtcatgcctaaaaagttaaaaatcgcatttattcatccagatcttggaataggaggagccgaaagactggttttggatcttgctggagccctaactctttcaggacatgaagtaaggttcctcacaaatcattttgatcccacccatgcatttgatgaattaaaaaatggagattatcctgtagaagtgtatggagactggttaccaaaaagtgttttcggaagatttcaagccctgtgtgcttatgtccggatggtatatatgtctatagtttatttattattctttaaaaataaggacaaaccggatctttacattacagacttaataccagtagcaaacgtatttttaaaaattgctggcgagaaagttatctattattgtcatcatcctgatttacttgctagtactcctggaggcgaactaaaaaaattctacagaaaaccaatagattgggtagaaatgaagacaacaggaaaagcagatgttattttagttaatagtgaatatactgcttcgatatttcgtaaaaccttttcaagcatacataaagatatccaaattttatatcctacaatcgcacgttcgtaccaaaatacagtagaaaacttaagagaagctaaaccaatacaagaattagtgccgcaaataaagaaagcaggtgacacaatagtgtttttatcgttaaatagattccatccagctaaaaagctggaatttgctattctagcattggccaagttaa

SEQ ID NO: 123 - DNA, 1656 bp, Diabrotica virgifera
  Annotation=Tubulin-specific chaperone C
  SmartBlast Evalue=1E-57; Info=Tubulin-specific chaperone C n=2 Tax=Formicidae RepID=E2BFJ3_9HYME
gaagcaaatctgtttaataaaagttaacaactaataaaactacattgtgtctataaataatgattccaactttgaattctatctttttcatcaatttccttccagttgggagaatgtttctgattcaaccaattgaaatcatctatacatgtccaattatttacagcagtatcaaaagaggcactttcaaagtcgctttcaatgccttcgtatttccaattgtaaggcgcaacgttgatatctttacaatcttccattatagctctactagttacataaagataaatatcggtatttttagagttgtgcaagcgcaactgttggcatgctatgaccaaaatacagttctcgcagttttcagcgaatatcgaagtactaactgggccggagaatatcctacaatttcttaagtagtttaagtgtaaagtggaaggactaccttgaagggacactgtacaagaatctaatttttctatagaaacatcctttttaagcagttcagaattatctaaagcgaggtgttcgttacacttattgaaaaaaccggtaacgtttttaactggctcaatttttggtttaaaatcgacatcgtctatacttttactttttatttcgctgttctgtgccttttgtttaactttatttttaaaggaaaatttctttttgggtagcaattcgtcttctacttgtttcgttcttactgttaattcctgtaaaatattctgacatttttgcatatcataattcctaataaaaatactcgaagctgctacatatttttgtaaagttactatttcttttaaaatttcattgaaatgatcagggagttcattcactgggacacttttagacagatctatcatgttttctatgtatgaccgtttttctgcgaatagagtttcgaaaaactccaatttttcgttacctgctacaagagaatccttgttgtctttacgtttttgcagattcagttgccgctccacttctctcttggttaaaagatttagtttgttagctttttcatttgtgttttcgaaagttatagtagaattcatgttggatataggatacagtgggttactagggtttacttctttccaaattctctctcgagttcttccttggttaaacgataaataggcttcttattttcggatgctgaaattataacatccataaactgttggtttttggttaaatgttcccggttttctttaacagtaagtaattcctcttttctttttctgatgtcttcttctgttggtgtagtcaaaattaaaagaccataactgacacctccacaagcaactaaccagaataatgatctaacaagtctagatgccattaagattccttattccagtaagccaaatcaatttgtcttatttgattttgggaatcaaatgtttctccaattttatagtatgcttccaaaactgatggataattctggtataaatactttcttgtatctctatctgtgttgactctataccaaagaaaatagcttccaacaaaacttgctccttctataacgaataacgccagagcccctcgttttagccactttcttacagccggttttggatttttaataagcataactggatgaaaattgagccatttggtgttatgcggatacttactggaattttt

SEQ ID NO: 124 - DNA, 809 bp, Diabrotica virgifera
  Annotation=A kinase anchor protein 10, mitochondrial
  SmartBlast Evalue=1E-61; Info=A kinase anchor protein 10, mitochondrial n=1 Tax=Harpegnathos saltator RepID=E2BQ42_9HYME
agtcagaagctgcgtttggatatcgctcaaagttcgcaaaagtcattcacttgtaccgtgtttatcagatctgacaaatacttataaaacaactgggaagttaaaaaaggttttaggtagttcttttccagaactgtttcgacgatctttaatggaagatgaaaacaatctggcatcaggccattctcgccgcaaatgctttgttctactgcaaacctaactttatcactgaaacctaagggacacgtagcttgaagagaaaaatatttatcatataacactacagcatcagtttgagcttcgacgtgatcaaaaaagtccttttggtcgtgtaattgttgctgaaaattcgaagcggctatccaaaactctagcaaactacgctgattttcttgttccaagtactccatgaaataaaacaaagcagtctcattgtacagaatatcatcaagagaaatattaccgcctgtaagcagatcgatctgatatttacagaaataatcagaagctaaaaatgatgcgaaatactcatcttgcatgatattataaacataattctctacggtatcaaaacaattaatggataaaactttatcagtattgcaaatattttccataatttctttcctcatttcctctgtacatttaatattacacagcgcctcttgtgctatatattttttaaataatagtaaggctttatctactatactttgtacacttctcttttcactaaaattagattcatcactttctttatcacatgtgttatcctgggtgttttaccctctgataacgttgttgccgaa

SEQ ID NO: 125 - DNA, 700 bp, Diabrotica virgifera
  Annotation=Cop-coated vesicle membrane protein P24
  SmartBlast Evalue=2E-73; Info=Cop-coated vesicle membrane protein P24 n=1 Tax=Culex quinquefasciatus RepID=B0VZH6_CULQU
tgtgttgggaaaatattttatttatattatgaaagtgaaagtaaacttatccagcttatcctaacccacaatccacaatctaattcagtcaaaatttaaaaatgggtcttagtgccacgttacttttagaaatatcttttgtggtcttgtgtttcctccaatattcagtccaacaagttacaccaccatggtatgaaaacctaccagcagttgctatggattataaagtttatataaatcctggaaaggaagattgttactttcaatatgttaacccaggagctaccttctatgtgagttttcaggttgttagaggaggagatggtatggcagggtttgcagttagacatcctaatggacaaatagttcatccataccaatggcaagcaagtagtgaatatcaagatcagcagtcagtaggaggctattactcagtatgtattgataatcaattttcaagatttgcaggaaaattggttaacatttacatgacagtggtgcggtatgatttatgggaatcatacacaaaagaaatagaatctcttaacatgaatatggagaatttcacctcaactattgtccaagttgaaatgaatatcaacaacatgctccaatatcaacatcattcaagagcacgggaagcttgggactttaatttactaaaggataacaattcatatgtaataaggtggtcaattat

SEQ ID NO: 126 - DNA, 796 bp, Diabrotica virgifera
  Annotation=Transcription initiation factor TFIID subunit 6
  SmartBlast Evalue=1E-72; Info=Transcription initiation factor TFIID subunit 6 n=1 Tax=Aedes aegypti RepID=Q173U6_AEDAE
ggggtcagctattggtgtggtgtgtgtttatcgtttatgtaaataaataaaaaaaagttataaatttgttaaataataaatatgataaattttggaaattggtaattaaaattcattagaagtaaaaaatggctaagataggtgatcacgatttgtacggtaccaatttttcaacagagtccatgaaagttattgcagaaagcataggaattgggtacttagcggatgatgctgcaaaggaactagctgaagatatatcgtttagaataaagcacatcatacaagatgctgcgaagtttatgaacaacgccaaaagaacgaaactattacaaactgatgtggattctgccctgaaagttaaaaatattgagccccaatatggatttcaatcaacagaacatttgccttttcggtttgcttctggtgggggacgagagctgcattttatagaagaaaaagaagtcgatttgaatgatttgctgcaaaatatgtgtccgaaggctcctctagaaactactttaaggtctcactggatgtttattgatggagtacagcccactatacctgaaaatccacctcccgttgcaaaagttgtacaaaaattggaatcagtagatccagtaaacaaaaaaccaataaaagaaacatcaggaaaaccgacaacaggaaaacagaaactcaaaaaatgtagagacagtccaaatcaaacagttggcaacccatgaactttctgttgagcaacagttgtactataaagaaataaccgaggcttgtgtagggtctgacgaagctaggc

SEQ ID NO: 127 - DNA, 1046 bp, Diabrotica virgifera
  Annotation=DnaJ-like protein subfamily C member 10
  SmartBlast Evalue=3E-89; Info=DnaJ-like protein subfamily C member 10 n=1 Tax=Harpegnathos saltator RepID=E2BMX2_9HYME
aacatggacaacatattacttatttttagatttttccttggattttttatctgattttttctttgctggagctgatttcaggaaaaatcttacaaacaatgatcccaacaagcccaaaacaaaagttccacctccaagttgccacaaccatggattttccctcatatattctacaaccattgcaacaaagtcatcaaacggagattttggtacaggtactttttctggagttacattcttgtgccaactttgagcaaaatcaactaaagactgtacatcatacttttgtagatgataacggtacaattttccttgtctaaataatatgaatgatggaacatttgttacttcaaaacggcgtccagttatagctccatctcctcctttattgatcctagcaatgtttattctagatctaatgtgggctccaactgcctcccatctggcttgtaagcgagtacattctacacattcagaggtataaaacattacaaaccaatcccctgtagttgcaccagttgcagcttgagttaagtgttcaaatgtattgtctgttaactctttagatatgggttctttatttgttgtaaacgtatgcagaattaattcatcatttaaaggaccatcatatagtaatggaatgccatgtcggaaaaataccaatactggttctttatcaggactatacaatctggttaattgactatcttcaactttcacaacccatgcatttaaggtttctactatgtcttccctgagcccagttaactcattttcataattatcacatgattcacagtactttcttgaaaataacactataacatgtttttcagttctaattaagttcattaactcttcatcttgaactacttcgagatttgattgtgcaattgaaaataaatagaataaaattgtacatattactattttttcatttttagagtaactattttatgataattaattttattatttgccgtattattacaagaacacttatttgaggttaaactgttaaaacagaaaacagaagtaagttgacg

SEQ ID NO: 128 - DNA, 614 bp, Diabrotica virgifera
  Annotation=GTP cyclohydrolase 1
  SmartBlast Evalue=2E-81; Info=GTP cyclohydrolase 1 n=1 Tax= Harpegnathos saltator RepID=E2BBM5_9HYME
ccgcctggaataaatctcgacgattctagctaacttgctaagtcccaaaatttttccacatggtaaatatccgatggaaacctttccgtagaaaggtactaaatggtgctcgcacatggaaaacatttcgatatcttttacaactaccatctcgtcgtggtcttcgtcaaatatagcatcgttgagcacctcttcaagactttgatcataacctttggtaaagaacaacatggcctttgcagctctttccggagtttttaatagaccctgtcgctctggattttcccctagtgatgccagtagcaatttgtaagatctcgacatttccggtaacatgtcttctctggtgggaggacggtggtctaattctaaatcgtggtggaaggtgcagttctcgtgacctggagttgtcgatgtgcgaggtgtctgaggtgagccagggacctcaacatctttaatctcataattttccgaccaagttcttgctaacaagggtcttggtttcttcgccttgatattatttgtagtatgatcaccattcacggtagccatggtatctacgatttgaaataagactttcacttgttcacgtgtttagatattcggcacgtaga

SEQ ID NO: 129 - DNA, 548 bp, Diabrotica virgifera
  Annotation=vesicle-mediated transport protein Vid24
  SmartBlast Evalue=4E-38; Info=vesicle-mediated transport protein Vid24 n=1 Tax=Aspergillus oryzae RIB40 RepID= UPI0001F2A600
tgacatttaattttgactttctaaaaaattggataagacagaggaaaatcttgagaaaatgccggttagggtggaaataacgcctcccctaccggcaaactccaaacaaccaggtgttaccaaatctttattgtacaatggctcaaaattccaaggattccagaaatcgaaaggcaatagttacgaggtggaagttattttacagcatgtagatgaagaaaactcatatctttgtggatatttacaaatcaatggacttacagatgagtaccccaaactgaccacgttttttgatggtgaaattataagccaaaaatatccttttcttaccagaaagtgggatgcagacgaagatgtggaccgaaaacattggagcaaattctcactattcagtcaatatgccaaaacctttaattcagattcttttgattacaaagcccttgctgatacggactacgtctttatgagatggaaagaacattttttagtcccagaccatacaattaaagatatatcaggagcctcctttgctggattttattatattt

SEQ ID NO: 130 - DNA, 1183 bp, Diabrotica virgifera
  Annotation=Transmembrane emp24 domain-containing protein 2
  SmartBlast Evalue=4E-75; Info=Transmembrane emp24 domain- containing protein 2, putative n=1 Tax=Pediculus humanus corporis RepID=E0VMZ0_PEDHC
atttacttattaatacaaatattttacaacaaaagaagcaacaaaaaaattttaatggtacagtgagaaatttcgccccaaaagatattagtttgaggtaggtatgtacaagagaaaacattatagaaaaccaatacttatttgtacttttccgtaagtttattatttcaaatataaagatctctagtttgttctattcgaactcaaaaaattcatttctgataaatcagttataaagaaatgattttaaatattgtgcagtgaattcaacagaacaaattaatagtaatacattactaaccagtttcagtcttcctgaatacaataaggttatcgatcataaacacaatcaattctgtaccatcagactttgtatttaaaactagagatcttttttttttttaatttacaatgtcccaaaattcaaattacatacataatttgtatattatcaattttacaaaattttaagaaatatgtaatgatcagacttaatgtttacacaactcttcttacttcgaagaacctcttgagatagtatacctgccctacagtcattgctactaaaattactgcttcaaagaaggaccacatgactaccctagaatttgtgctttcattgatgcttctatgaattctgtctctaacctgcatatattcttgttcttgttttacaccagacaatgaatttgtaagttctctgatcatttcctccaacttattagcattttcaccttcttgttgttctgcctttggagattccccaacagccatattaaacataacaactttaggtgtcatagttgacatcttgtttgagaaacaatatgtatatataccagatgtgtgggctgcaaatgtgtattttccggcagtttccctttcaccctggtataagttctggccgtttggatctataatacgcacatctatgtcaaggaatcctccttctgctatttcaaaagtgagacccatttttgtgccagcttccactttgtcaaagaaacattcttctgcatgtgcatctactgtgataaaataggccaaactttgatttatgcccaaacaaaccagtgaaataaggaagccgaaaagatacatgtttactttaaattaaaattagaaaacttcggccacgtaacctctcacacttgacgttcaagtttgaagaaggttgatgact

SEQ ID NO: 131 - DNA, 941 bp, Diabrotica virgifera
  Annotation=Transmembrane protein 145
  SmartBlast Evalue=3E-71; Info=Transmembrane protein 145 n=2 Tax= Formicidae RepID=E2A0J4_9HYME
tatagtgcacatccttttatatgtttggaatttgacggaagtagacattatagaagacatagatgaataccaaacgtggcctggatggttaataatagtttttaggtcattaataatgatctggtttttatacgagctgcgtactaccatgttgtatgaacataatacgcaaaagttgaattttttactacatttcggggcctctagcttggtctggttcatttatttgcccattttagcgcttatcgctttacatgtgtctgcgttgtggagattcaaactgttgttaggtataacttactctgcggactgtttcgcgtactgcgtgatggcccacctgttatggccgacgcgttccgagcagtacttcctcctgaagggcccctcatcggccgacctcgaggagctagacgagttcaacgaagcgccgcacatcgtcaacaactcctacacctcgatgtccagcataaactcctatgagatttgtaaatacgacgcaaacgacacccaaaaaaccaaactgatcaacgtcaacacgtgaggggaattttttcagctgtttatgtgtttttgtgtcgattgcggaggctgtgttgaaacgaaaaaagcgagattttgactttttacatactgacgtagtttatgttaaacttaggcggttacctatttgataagttgaaaacgtatttttgtgcaatatcgccaagtcaatttaagaatgaatatttaggattcctaaatagttatagattagagattcatatatactgcagacttcttgaccagttgctacattcgcctttttttcatcacttatgtgttaaatatcgatatttacagtacattttacttaatagtttcattttacttaatatagacttttattacatcatcattatcatcaatatagtgctaccgccctcaagagtgttgactgcgcc

SEQ ID NO: 132 - DNA, 672 bp, Diabrotica virgifera
  Annotation=UDP-N-acetylglucosamine--dolichyl-phosphate N- acetylglucosaminephosphotransferase
  SmartBlast Evalue=1E-76; Info=UDP-N-acetylglucosamine--dolichyl- phosphate N-acetylglucosaminephosphotransferase n=1 Tax= Harpegnathos saltator RepID=E2C6L8_9HYME
aaactgatgtggtttcgggacaggcccaaacagttcgataacattaaatataataattgacagtgctataacaacactttgtccagtttctaagccattaactccagctagaatgtttattgcatttgtacagaacacagctagcattcccatatagatataatacaaaattccaatatttactgaaaaccccagtaaatctctgaaaggtttaggtactacgatcgttgtggaattaaaattcacatagtaaaccattagtagaggtagggaggctattgttggcagtagaagtttgtgtctccatttcagatctagtacatcatcggcaaatcccagtagcagcatgcagcagattgataagagtgctgctatgagttccacaaactcatcatgggggaaatcgccatgtatcaagctggttccaaacggaataggtataaataaaaacatggtaataaggaatgcacatcctgtaactacacctaatgattctggcactttatcactggttgttttgctcatatcaattccaaacaaatttgctttgataaatttatcctttattcctggaatcaacctaactgtaaaacagtaagtcccaatggacatcaagaaatttatcattattggaaaatacattttccatgaattatttaagtctgtgtttac

SEQ ID NO: 133 - DNA, 2173 bp, Diabrotica virgifera
  Annotation=CG8290, isoform B
  SmartBlast Evalue=6E-37; Info=CG8290, isoform B n=4 Tax= melanogaster subgroup RepID=Q961B8_DROME
cgctgaagacgttgatggagagggttctggagcttttttcttttgaggtatacaacactgacagtgatcgatcttcataaaattttcaggatttgcatcatttgttgcgtttctcatttctctttgaacatattccataaattcagcacaatgtatcctaagattgattagttgtgatggattgcatctaaaacacgtccaatcgtcacttttctgaatatcggctagctttttcctatcgaagttaattcggatacatttcttacagaaaaccatttcgcaatttgcacagcacagaacctgcccaccttgcccacaccatctgcaatacaattcgctgccatcttcgtctttttcgaattctccactagtgtagaaatggtaacactttttgcaaatcagaacttttagtagcgggtgaacgaatctgttaccttgaccgtccaaagcgctgcctaaatggatgttacaggcagtacaatggatcttagttaactgtactggatttttttctccaaaagttttagctttaagttctaattcttcagcggtcaaattgaaatcaatctcagcgccggtgatttcatcaacaaacgtcgaaaatatcggatcatatagacgtaatggactattgctaccgtcaggtttaggggcaggtgcatcactgtgtgttataacaggtgcttcttctatttccatggagagttccggcataagaagtgaaggatcaaaatcctcgtccatatcaatatcgtcatcatctggcctataatcttctaccggtttcgttagactttcttttaaaagggattttaaattggcatcctcctcctccttttcagacaccgtttgttcatttttgtcatctactattggacaatctgtagaacttgattctgctttagaagtggcttccttatcactaccttctacatttttatcttcattggtttctttatcctcctggctgattttgttttcttcgttgctgttagtcttttcactttcatttttctcaacatcttctttgttttcttcactgctgtcggcttttccactttcttttttctcaacatcttcagcagaaacagttttttcgatttccgtaacatcagcttccttgctttcttcttcagttttgtccatcttctcacattctatagtttcttctttatctttttcttctgcttttttggttgtaattttcatcttcatcatcatctacttgttttgtaacagtatcctcggttttatctataatatcatttgtgttctccttctcagatctatcaacagatttttcatcctcttcgacatctttgcttgtatcatcatcatctttgttgttttcatcatctttgctgttttcatcaactttgctgttttcatcatctttgctgttttcatcatctttgctgttttcatcatctttttaagactatcacaattatcttcattttctttatctatgtctgtctctgttttatctttcttattatcatcatccttatctgtagtattattactttctgtatcattttcatcgttattatcgacaatttcagtaacaggggccttttctgtttcatcattattaacatcttcttccagtctatcacaatctctctctccttcacaatcactatctagtaagtctctatttacgggactcaaaggttcaccaccatcactgtgtgcggggcttaacaaaagcttttcttgaacttcttcacagtcctcatcactttcactttctacaacagatgtgtctgtttctttagtttccttattactttctttattttcaggactatttttacatcttcagaaacctccactggagagtttgcttgatcattttctgttaaatccgcatccattgtgttttctaccatgttttcagccctttgctcatagttactgagcgtatctatttccatgttcactgaagaaatccatcaaatcgcttttccttcaattatgacacattgatatcaaaaagtataaaaagtagaaaagacgctttacaaacgtcacttttatcaaaatttcacttccctcggcaaaaacttttccggtaattaccaaaaatgctaaaatgtcacaattttcttggttacaggtacgtaccacgccaaattgaaacacggtgatgtggtcacccagctattag

SEQ ID NO: 134 - DNA, 2301 bp, Diabrotica virgifera
  Annotation=Charged multivesicular body protein 2a
  SmartBlast Evalue=9E-81; Info=Charged multivesicular body protein 2a n=4 Tax=Apocrita RepID=E2AM53_9HYME
ggtagggtgacgagcagtgtgactcatttttaattttatattgtcaaatatttaggtgttttgctggttattattattatattatttaaaaatggagtggttatttggaaaaaaagtaacccccgaagaaatgcttcgtaaaaaccaacgagcattaaataaagccatgagagatttagatagagaaaagcaaaagatggaacagcaggagaaaaaagtaataaacgatattaaaaaattagccaaggaaggtcaaatggacgctgtcaaaataatggctaaagatctggtcagaactagaaggtatgtgaagaaattcatgttgatgaaggctaacattcaagcagtatcattgaaaattcagactcttagatcccaaaatacaatggcacaagctatgaaaggtgtcactaaagctatgcaaagtatgaataggcagctaaatttaccacagatacaaaggatattacaagaatttgaaaagcagtccgaaattatggatatgaaggaagaagttatgaatgatgccattgatgatgcgatggaaggagatgatgatgaggaggaaactgacgcagttgtcaatcaagttttagatgaattgggtcttcaattgaatgatactctttctggactgcctcaaaccgctggatctcttcctgcctctgggcaaaaacatcctgcagctgcagctgctgttgcaggaggaggtaatggtggcactggtactggaggcagtggtggaaacagtggcggcggaggtggcctttctgatgccgatgcggatttgcaagctcgactagataatttacgcagagagtagatattaagtaagataaaagggcaattaaaaaataaggaactttgtatacacattatattttaaaatcgacaaaaacttgatcttttacaaagttaattcttgtagcttattttttccacttactaacggtgtaattatctgtgattttcttaaaatataacaattctcaaatataacaatcttctgtaataattttttttatcaatttaacaaattaattaatgcgaatatatttctgtatatacataattaaatattatcatataaaaaagtatttaaaataaaagtattttatgtatttacttttatgtttaataaaattcatattaataaaaatatatatatatttttattttgacccatcctataaatagataattgggcgttagtattatcataattgcaagtatttatgaatgagttaacaacagttctaggaatttaaattcttagttgcgtctaataaaaataagttgttttatgatattgtataaaacaaatttttgcccagtgttatagtacattttccacagtatgttactggtttgacttttttcctggacatcgtgcctactcttcacgtttctccatgaagtgttctttcccatcgaattttatgtctttaatactctagatgctgatgttctctatcttcctatggttcttcttgtactaagagtcaagttaaggtaggaaactgctactgacttatttactagtttttggagaagtcataaattcactaatgccataccattcttctcaaagctctattttcatctttttttctggtgtatatgttatttcctgttcccgtaactacgtatacatcggcaaaactatccgattcatcaaaacccaattccaaaaatatcaaagatactttaaatcttcgtctaaagtttcgtccttattccttttctgcaatggtagaacaccgccaagataaagtacattccatgttttaaaaaaaaaatttttccaaaaatctctccttctattaccgaaaaattagtgaaacggaagaaatctggaaccaacactgcagtgcctttcagaacaaatcaatagacgcgacggcggaaacagcgatcgacgccatccgaagggacatcacaatggtggagaaacctggtggaaaagtgtataaggaccgttgcataatgttttagacctagaatctatataaaactatgtaatgaaaccatataccagttaaaaaaaaacagttgaaaacaaaaaagaaaccggacgatgaatagtttagtattcagtaggttgaaatatttcaagaaaagtgagacacgtgtatctaagttctcgctctgactttggacactgatcttgcgatatcaaaaaacaaacaatatgtaaacaaaaagtttaatatttaataagtattaattttaaaaaatcccacactgaacattcatatattgaagtttccttattttttattgcaaaaataaatacactgc

SEQ ID NO: 135 - DNA, 706 bp, Diabrotica virgifera
  Annotation=Cappuccino
  SmartBlast Evalue=5E-88; Info=Cappuccino n=1 Tax=Tribolium castaneum RepID=D6X070_TRICA
ctgttcacaaacttctaattgtttttgtaacttcttcagatccaacctcacatcatcgaagttaacagcagctgctcttctaatatcaccaggttcaggtacaggtagaggcagattggcttcgtaaggggtttttaatttttttcatataaactttgacgacatagtgaagaagtgtaatttttgaatcgttcgattttacgtctttaagtttggacaaaatttctagaccgaacccatcggcttgtcctctggccatgttgccaccgttcatgtaatttcctaaggttaatatgatcgccattatttcttttagttcggggttgttcattaaaaaatcacaggttgtctttatgttggttaaagtatgactgattgtatttattgagtcgtctagttccacctgaaacatcagacaggatattctctctgcaaaatttgatatttcggataactcatacaaaaactgctccggtttgtctagtggaatattaggcgatgtttccaaatgtgccttaatcatttccagttcctcggaatttgctctcacttcataaatctgatgcaaagcttctaaacctataaccgatgtatcaaaattgtagattgcgttttctatttcctgaatatccgtctttaaactttgtgccagtattcccacattctgcgacctcttactgtccagcaacttaacagcagctgcctt

SEQ ID NO: 136 - DNA, 1021 bp, Diabrotica virgifera
  Annotation=Protein MAK16-like protein A
  SmartBlast Evalue=2E-68; Info=Protein MAK16-like protein A n=1 Tax=Camponotus floridanus RepID=E2AY66_9HYME
tgtttttaaaatatcacgtgtaaacgtgaaaatctaagtcttcgcctgaagtattgtaattaaagttaaaaatgcaacacgacgacgttgtttggagtattataaacaaaacacattgttcatacaagactcaaaccaagacacaaaagttttgccgtaacgaatataaccttacaggtctgtgcaacagatcggcttgtcccttagcaaacagtcaatatgcaacgatcagggaagaaaatggtataatctatctgtttatgaagactgccgagcggtcagcgtttccaaagaagacctgggaaaaggtaaaactatccagaaactttgaaaaggccatacatcaaatcaatgaaaatttactctattggtctggttttattaagtcaaaatgtaagcagaggttcgtaaaaataacacaatacctaattcgaatgagaaagttgaaattacgaagacagaaattgttggttccgattcagagtaaggtagaacgaagagaaagacgcagagaagacaaagctcttattgctgctcgaattgaaaagggagttgagaaaacgttgttagaccgtttgaaacaaggtgtgtaccaagatttgtacaatatatctccacaaacattcgatgaagcagagcaagagagagaattggaatctgaggaagaggtagaacaagaaatggaaatggaaaacgaaatggaggaagacgtagatacaccggaatttgttgcagcagattcagatgatgacagtgatgttgaaagtgaaagtggtaatcctgaggaagtggatttagacagtagttttgaatcttcagacggttcagatattgaagatataagacctagtacttcaaagaagagccagacacctgtaaataagaaaggtacacccaaacctggatccagtaagaagaagcgtaggtctagggttgaaattgaatatgaacatgaaccagctcaaagactgtctgttagttaaatttttttaattgtgattgttacactttctttaataaa

SEQ ID NO: 137 - DNA, 778 bp, Diabrotica virgifera
  Annotation=CG5131
  SmartBlast Evalue=5E-80; Info=CG5131 n=5 Tax=melanogaster subgroup RepID=Q9VJD0_DROME
gatctaaatctgcataacatgtaatatgactttagtaggagatttcgaagaaaaatcagagaaaaatgttaatagccaacaaaaccaagctggtacaataccacccgatgccagtcaatggggctacgacctatatccgagcagaaaatcccacaatgattcagcttcaatcacagactatcttaaaggaaagggcaaagagaatatagataaaattcattgtgagagaaacgtatataagtgtataaaagaaagtccgatggttaagttaatgatgggggctttgaaggcttcagggtgtactgttgatattaggagacatatttcttgtgaggagtgtgctcctactgttagtggaggctatgatcctataatgaatcaagtagttatatgtcaaaactctgccacaaaagtaggcgcagtgaacactgtcctgacacacgaaatgatccacatgttcgactactgcaaaaataacgtagacttcaaaaacctcgaacacttagcatgcaccgagatacgagctgccaacctggcccattgcagttttctccgcgctagttgctggagatgcctcacttttttacatcaaagaagcccaccaatactgtgtgaggaataaggcgctcagttcggttattgccgctaggaacgttagtaaagaggaagctatggttgctattgataaggtcttttcaaaatgttatgcagatttagagcctgtaggtaggagaataagaagaaattctgctgatatgtataaggcatatgaagaggg

SEQ ID NO: 138 - DNA, 1154 bp, Diabrotica virgifera
  Annotation=Protein LTV1-like protein
  SmartBlast Evalue=2E-69; Info=Protein LTV1-like protein n=1 Tax= Camponotus floridanus RepID=E2A666_9HYME
ggggacctgtcaaaaacacgttcttttagttctgcctgctgtcaaagtaaataaataaagtttttttctgataatatataatcaaaatgcccaaacataaaattgataaacaaaaagctgttactttccaactggtacacagaagtcagcaagatcctttgatagcagatgaggatgcaccccaaagggtacttttgccaattaaaggcaagcagagaaatactgaagatttgtttaaaaataaacaaaaagcagagtcaattatagatgaaggggatgatgatgaagactttagtgatgatatggaagagtcagaaggcgaagatcaagaaaaagtgaaggaattgaaggtaaagttcaaattaccaacaacagtgtttccatccgaggtcgaggaggaggttggaatgctaggaaaggcagctcctgtatcaggtccgcagctccacttggatccagatgtagtagctgctatggatgaggactttgattactcagatcctgaaaaccaacttgaagacaactttatagaattagctaatgctgttggttcaggccatatgaatgaagatgatgatgaatatgatgacaatatgtcgggttacaactctgaagatctagatgaagttaattcccttttagggtctgatgcgtcatttgaaaaagaagaaactaaatccagatttacaaattactcagttactagttctgttatgagaagaaacgaccaacttagtttgttagatgagcggtttgaaaagatgttcgttggctatgatgaaaatgaaataggggctttagattgtgaagaaattgaaggtgacgtatcggcagatgatatattacaacgttgtgtaaacgattttcaaaagtcacaaactaacgaagaatcagaaaagaaagatgtagcgaataaaattaagaaacaacttgaaatacaccctgaggaagaagaatttgtagaagttgttgaacatccaaaggaaaagtgggactgtgagagtattctgagtacttattctaatatttataatcatccgaagttgatctcagagccaaagacaggaaaaattaaaataaacaagaagactggtgtgcccagcaacgttttcaatacaagcaccttaacgtctaaggctctgaataaacttaat

SEQ ID NO: 139 - DNA, 612 bp, Diabrotica virgifera
  Annotation=RING finger and CHY zinc finger domain-containing protein 1
  SmartBlast Evalue=9E-72; Info=RING finger and CHY zinc finger domain-containing protein 1 n=1 Tax=Harpegnathos saltator RepID= E2C4B9_9HYME
gaccgcatggtggtatatgacacgctattctggatgtatggatgtcatctaggcatataggacagttggatctggagacgttttctacacacttatgtccactttcaatttggtttggaaggcacatattgcacttctcacaatgaaagaatctatcagccccaccaatcctacaaattccgcatcccttgcaatggaactgctttttgtcttcatcatcaaataaattacattctaggcatatatacttcccaaaagctaccccacagttttgacaagagctttggactctttgctttgtttcacacaaagcacatatcagctcagttacttcttttctaatcaacttatggttttcattttcgtcatgacaaaatctgcaggtgtacactttcttgcagcatggagtcacaaattttgattttcttttgtaatggcaacaaccaacaggcttaactgtttcctctggcggtccttcagcgctgggtgtggacaccccttccattgtttccttttaaaaagataatattaaaaccaattttgcacaaaaatccaagaagttttaaaatttaatagttttagttttaactttgctggaaataaatgtcacaa

SEQ ID NO: 140 - DNA, 593 bp, Diabrotica virgifera
  Annotation=Aspartyl/asparaginyl beta-hydroxylase
  SmartBlast Evalue=8E-72; Info=Aspartyl/asparaginyl beta- hydroxylase n=1 Tax=Culex quinquefasciatus RepID=B0W3R0_CULQU
tacccaaactatctggtaaaccgtggtggaaccctgaagacattccatacccaaaattcttcaatttgttacttcagtcgtggcgaaagataagagaagaaggtctatccattttaagtgaaaaaggctatttccaagacgagtcggaaaatctgaaagatactggtgaatggaaacaatttgagttatatgcaagaggacagaaaaatgtaaacaattgcaaaaaatgtccgtttacttgtagcattatcaatcaaattccagaagcaaaaaattgtaaaagaggacaaacaaagtttagtgtcatgcatcctggtacgcacatttggccccattgtgggcctaccaattgtagacttagagcacatttaggccttaaagttccaagtaatactttcctgagagttgcagatgatataagaagttggaaagaaggtgaaataattgtttttgacgacagctttgaacacgaagtatggcataatggaacagattttagattaattttaatagtagatatttggcatccagaactaacgccgtccgagaaaaatactctttcgccgatttaattgtttgtattcacaatttgt

SEQ ID NO: 141 - DNA, 565 bp, Diabrotica virgifera
  Annotation=Presenilin sel-12
  SmartBlast Evalue=8E-71; Info=Presenilin sel-12 n=1 Tax=Culex quinquefasciatus RepID=B0WS38_CULQU
taatagtgttaatgactgtactgcttatagttttatacaaatatagatgctacaagactatacatgcctggctcattgtatcttcattaatgctactttctattttttcatatttatatttagaggaaattttaagagcttataatatcccaatggattaccctactttagcgtttctaatgtggaattttggagtgatgggaatgatagtgatacattggctaggtcctttaaaattacaacaagcttacctgatatttgttgctgctctcatggccttagtatttattaaatatttgccagaatggacaacgtggacagttttggcagttatatcagtatgggatttagttgcagtattattaccgaaaggtcccttgaggatattggtagaaacagcgcaagaaagaaatgagcaaatatttcctgctttgatttattcatccacctttatgtacacctacacaagcatggcaacaggagatgttcctaatatcccaagatcagacagtgaggatcacggatttacacaagactgggtagctagtcacgccaatagaggggc

SEQ ID NO: 142 - DNA, 1956 bp, Diabrotica virgifera
  Annotation=CG8108, isoform A
  SmartBlast Evalue=1E-46; Info=CG8108, isoform A n=5 Tax= melanogaster subgroup RepID=Q9VT61_DROME
aacattgaatacatttattacccactaaaatacataaactgattgtattcgaaaggaatgaaatatgcataattatattaagctatgaaacatgaactacataaataccttaagtgctaatatacaccttacatagtacactaaatctactgaacaccatagacacaaatataattaatatttatttagtttctacgtcattgataatcaacttattctctactccatcttcatcccctttctcgcttagtttaaacctatcatatctctcaccgttaatacgagaatcttcatcttcactctcactcttgtttccttgagcctctgctaaaatatcgcctaggtctttatcaacatcagcccacaacttatcctcttctttagtttggtcttcggtttttggcacgactttaactccttccttcttgctgactaccttgtaacgttgaacatgcacacgttgtttgcaatgacgagccaaaataggagccatttcagattcttctgctctttgaagatacatcttacacaagtcacaatagtaggcttcgattttacggattttctccaagcccacactttcaccaccttctgcattttcctcatctcccactgaatcaatggtggtgaaattctctatatcagtatcatcaacgcctcctcgttgtttacgcttaatatgatccactgtgcacaaatgtttttcataagacatgggactcttaaaggccagggtacaaactttgcaagtgggcatcaagaacttcttcatgtttacatgtgactcagataattgatgcacagctttcttttgcttgaaattcagtttgcacaggggacagtaagtagttacactgtcgagatccgcagcacccttttccaattcattttgagtgttcctctgagcacggcgcatctgatttaagatcgctttctgcttaaaagcaactcttctcattgcaagagaatgggtacggctacccaaatgcaattcatatttcttgtaggtcaaagcccgcatatggcaatgggggcattgaagtttgatgaaagccttgctttgttcttttctctcttcattatccttactttcttcagtgatttgtgcttcctcagcctcaatttctgcttttatatcctcatctccattttcagcttcagcttcttctatggcatgtcttcttgcaatggccctcctgattctagctatcttaagcctccttgcatattcagatatatgtggaattctcctgccaatagcatatgatctaggaactagagttctaggcctagctcttatactagacgagccccttgaactaattcttccacggtaagaaccgcgttttggtggaggtccagaaggcctacggaattcttcccttcttgataatgaagagtgatgttcacttggtcttcgttcatatggtgcttcatgtctactcgaaccatagtaactttcatgcctggaactaggagcttccaccctcaaacgtttacgttcaggggatcttctttcacgtaccatgatactggtgctatattcagctctgtaaggcttatattcttctctatatctctctgaagtcgaatacttgggctcgtagggattcctcgattccattgcgggtggataggatctgctcgagggataccctcctgaccgcgaggagccattccaggacgaaagtcctcggctggaacctctggaactgcccctgtagcctcctctaggagacgatgggaatctacctctaggcatatttgctgatacctattacgactacaataaaactcaaaaagtctggtaaaatacagattctccgtattacttagatgtgtatcacgtaaatattttaaaaatacaacgaatgctattattaaaattaaaatttactaccaaattgatttttttaagtgtgctctcacctacaacctttcacttcgaccgacgac

SEQ ID NO: 143 - DNA, 714 bp, Diabrotica virgifera
  Annotation=NADH dehydrogenase
  SmartBlast Evalue=1E-84; Info=NADH dehydrogenase n=1 Tax= Ochlerotatus taeniorhynchus RepID=B8XY14_OCHTA
aataagatatattctacaactttttacaattttctatatatttcaacgatataaatggtcagcatgaatattactggctatttcagactcccatttgtcgccattgtttaataacttttctttattatagagaagttcttcatgagtctcagtagagaactcaaagttgggaccttctactatagcatcgactggacaagcctcttggcaaaaaccacagtaaatacattttgtcatgtcaatatcatacctagtggttcttctagagccatctgcgcgttcttctgcttcaattgtgattgcctgggcaggacagatggcctcacacaacttgcaggcgatgcaacgttcttcaccagaggggtaccttctcaaggcatgctcacctctgaatctaggactgagaggtcccttttcaaagggatagtttatagttgctggttctttgaaaatgtgagccaaagtaacaccaaatcctctgaataattcagtaaagaacattgtttgggcagcacgatctgtgatagccccaaactccatactgggttctttgtcgtttacatagaaatatccatctttagagccgctagagcaacatctttgaccaacaatctggacacttggtcttactaattttgagcctactgaaaatattttacgaactcctaaactcattttgaaacttttttatggattttgaatgagttatgtcac

SEQ ID NO: 144 - DNA, 865 bp, Diabrotica virgifera
  Annotation=CAAX prenyl protease 2
  SmartBlast Evalue=3E-74; Info=CAAX prenyl protease 2 n=2 Tax= Formicidae RepID=E2AL00_9HYME
ctataacaaacttctttacacctttgtacgtaataacttctgtaaaatctgggaaacccatatggttgcagaaggcgtgcacaataaataccgaaacaaaatgtccagttctgtagaagatatatgctgagtacattccaaatattgtggtatatatgaactgaaagcaggaaatctttagagctaaatcaaatgccattcccatatgatgtatacgttcccacatgtgatgaaaatgggccaccccgaaaaataacgggctacttagtactgatgtaaggggagtgaaacagttcagtaacataggtactatacaacttctaaatgtaaattcttcagtaaatggtgctacgatatgatttctcagccatattaggtttttaagattagaaaaccaatacatctcttctatgtagactttcgataaaccactgtacagttccatggatatgggtcccaaaaataggatcattgttagaaatagaggcatgaaatagcctggcatagtccctgagttctcagtcctagtatttcaataaatgtatgcttctgtagcatctcttgatcaagaccaatgtaaagaaaacaaggtgatataaacaacataataaaagcacttatgaaccttttctttatcgttgatgggtggtctctgccgtgaggatttttccatatatgaagactaagtaaataggtaacagatagtaagaagcaaaggataattgacttataacattgtatactttccttccattccatttttgaaaaagttgaatttatcacttaaagctaagctcattttttatctcacacttagcaaactatgaaataatcataatttaacataaattctaaataaaattat

SEQ ID NO: 145 - DNA, 531 bp, Diabrotica virgifera
  Annotation=Adaptin ear-binding coat-associated protein 2
  SmartBlast Evalue=4E-71; Info=Adaptin ear-binding coat- associated protein 2 n=1 Tax=Culex quinquefasciatus RepID= B0XD83_CULQU
gccctctgaaccatctttctttgttattttcatgttaattttgattgtttccccttctttaaatccaagatccaaacctggtccactgggttcttcattgatttgtttttccttcttcacccatttgaagtggtcttgaagagcaacatttaagtcgaatgagtctgatctatctccaaaaccaatgccaatgaaagcagttcggccattatcatccataatacgcaaaacaaagtatcttgacgaatcactaacaggttcaatggctattccagggtaggtatcaatgggacattttgcaaacagttccccagagttcttatcctccaatttgataaacagttcattgccttttgaaatcaatctcattcttcctgtccatgacggttccgctaagttccaatcggcagccctgtaatttctatttgatgaccttggtggaatattaaaaacgaatacttcaggtttaactagcactacgctttcgtaggtatccatttggaatttttagtattattttacaaaaagaac

SEQ ID NO: 146 - DNA, 671 bp, Diabrotica virgifera
  Annotation=Integrator complex subunit 3
  SmartBlast Evalue=4E-49; Info=Integrator complex subunit 3 n=2 Tax=Formicidae RepID=E2B3A5_9HYME
aaagatgaggtgacaggggagatatttccagatgtcctaacagaagacaaacttacagatagcatgaagtctcctctctttatgatgttcaaaacgatgtatggattaactaaggatgaactaggcaaagatgtactgtacaaattgatttcagagatgtatactgaattaccaagtctgggttacctgattatttattacctcaaagcaaaaatttggaaggacaacaaaaaggaggaccattcagtggcaagtgcattgaagataagtgtgtacaaagacttctgtcaaagtttagagaagaaagtagatatatgtttatatgatgatttatatgcatgtcatcacagtgatacaaaattgatgatgtggatagtgccagatttatatagagactttaaaccacaaacagttaataatgctcaaatattgagggtaataatttcagcaatagatcctaggcaattacagactttagtgggaaaagtcctccagggccatctgatgatgttcaaaccagaaaccatcatacctctattgaaagcgagtctacagtgggagagcatagaacagtttttcctgtggcagcttgtcaatgcccataatatatctatagatactgttttaccattaattacagaattagactatgaccagcatccagaagcttt

SEQ ID NO: 147 - DNA, 580 bp, Diabrotica virgifera
  Annotation=Actin-related protein 5
  SmartBlast Evalue=7E-68; Info=Actin-related protein 5 n=1 Tax= Harpegnathos saltator RepID=E2BG39_9HYME
aatattctgttcatagtattcagtactggtccattttgccaattcttctttgtaatcaggtgctattgcacatatgtcatgcaataattcttcggctctactcaaagtaatggcagttgcatgggcaggatatttcagttgtaatattctatgcaaaaatgtcactatgctccacccaccaatgttcagtctcctagtgttttcaaaaacagtgtagttgtttatcactggaataatatgacatgtctgatatcctagatttactattaatgcatcttttaaaggctctggttgggtatagtgataagaaaaaagagcatcgacaccatacgatatcccaggtacttcataacactcaaacaataactccgacatcaattgtcttgaggtatttggatttaaaaatgcttctgttaacactataggatgattcacacgattttcagtatcaattcctaaatgtgtaaaagtgtaatcaaacaaatgctcctgagcctcaaaatgagttacaacattacgatcaaattgagtttttagttgaaatcttacagcttcaatattaactatacccaacacaatg

SEQ ID NO: 148 - DNA, 910 bp, Diabrotica virgifera
  Annotation=Etoposide-induced protein 2.4-like protein
  SmartBlast Evalue=3E-67; Info=Etoposide-induced protein 2.4- like protein n=1 Tax=Harpegnathos saltator RepID=E2CA12_9HYME
ccacgagtcagataactgggtaacaatggccattggtaaaccaaatcccatgaagtaaggccaatgagtttctatgaaagacagtcttttgtgtaattcccatcccatattaaaccacttatactcaaatgcgtagagagaatataacatacacatctgagctaaagataatgtatatcccaccatgtatattggtatataactcacagctgtagcttgaattaaaaacaacagttggatgagaacactgaagattgaatcagctaaaactttgctcaggctctgggaaaataccggtcttcccctgctatgcctataagctgaatctgcaatatcctgaaaccataaggcattgaccactttacttaacaaaaacaaaggaataacccatatagttttaaatataatggacactatagtttcgatccatgaccatattcgtttacccataaatgattcccttccatatacgtatcccaatgattgatttacactcgggagaaatacatattcaaataaaaggagactgctcagaaatataattccattaagtgttccacattgcatgatcctctttatcactttcgattcttcatgtctctttagttgcctcaatggtgtcccttctttggggtctataggcttttgcctaacagagtttagtctggttggagactgtctagttattttacgttcatttatttctttatctagataaataagtgcatacattccagtaaaactgtcgaatacacctctaaatacagcataaaaaattttttgtatatccattttcttatctacaaatatacccactttgtaattaatcgatttttgtaattcaatatcgttacaaaaataatttagcttttttcataactactaaaaatttttgtaaacatttataatc

SEQ ID NO: 149 - DNA, 2334 bp, Diabrotica virgifera
  Annotation=Leucine-rich repeat flightless-interacting protein, putative
  SmartBlast Evalue=1E-59; Info=Leucine-rich repeat flightless- interacting protein, putative n=1 Tax=Pediculus humanus corporis RepID=E0VVS4_PEDHC
ttaagaagtaaaacatatctagaagggctaaggcaagaatctataagatattgataagaactatagcattatattataagtcagtgaaacatggacgatgaacaaatccgaacaaatgctataagtatagaaaagaaaattactcagggaaatatttggaagaaatctatggaatcgaatattgataaaaagacgaaatgttacatctttaacgaaatctgtaatatatgtatctgtcttttattccgacctttgtcggcgtccctttaaagattttattactctttcctgagatgcagacaataaaattcgcacaggtgctttgtcagtctctgtatttgaagatccaaaaaagatcagctaataaaagaaattattattttctcctatacaatgaaatgcacgccatcaatgataaaactactgtcaaaaatatcgactaactatatctccattttaactgataatcggaaacttacccgaatattcactatttaaataccactgtgacactttatgtaaatgtgtatttataagtaaaaggtacttcacaatgatatataacaattttcctaacaatagaaaacattaactctgttaaaaatatttgaaacactctgcatagtcgatagttaataaaatcgtttaatttcaaaattattgattacgtacgaatttttggagaagtaaaaaccctggaaggtttttagtcttaaatttaaatagagtacctagttaagtagtacattgaactacagttctttcagtaaggccgatttggcatttttaatttatctaatctcttaagcaaatgcgaattcgcagtttcaagttcttcagctcgattaagcgcgtctcttgccaaaaacatcttaaatgctttcagaaacatcagttgataaatcagttaaagaatttgaatcctcccgctgcaatttcctcttctcggccttaagaacttcttctgactgttccgaggtttcagcggcagttttgtacctaataacttggctttctagtcgtgccactgtcgcttgaagtgttgcaacatcttgttctgctttctgagctctaaacttccaatccgacaattgatttctcgcttctctttgaatatcgtcataatcatagtcagaagagggtccattcaagatgccacccgaacttatttcctccttttattttttcttcttctaattctagttttaaatggctaatttgatcttgaagttcgtttttctctttaaggaaccgagataaccgtacatctaaacttccatctcctgcagtttctaacaaatgagcattttccacactaactaaagccttcttcggtggatgttgtacttcttcatcgtcatcatcaggcgatgcatcatcacccactatcactagccccttttctgatattagtcgatctcgttcttcgagttcgtacctcgtcactgctaaatcttcttttaatttagcacaaatactttttaaagtttggtgttctcgacatttctctcggtgctcccttttaagttgagaatgttcctcttctaattcttccagtctatctttcaacagttctagttgatacgtctgcgcagttttgtcgttatccaactgagcattggctatcatcgcttttcgaaatttatcctcgacttctttcaattcgtgccttaattctcttaaacttcctccatcttccaaagaatcttctgagcttcttcggctggacaagtatcgatttccagcacttctcggggtccttaccaatgaggtcggttctgaagacagcatgtcgaattgcctgtctgcattctcttcctgctctttttgttgtcgttctagttccctcattcgtatctccctcgcttcggctctggcttgcctttttgcccataatcgcgcttccgcctcttcgttcgtacattgcataaaagactctattacgctatggtcatcgtcgtatctctcatttccacttttgttatccgattcactacattcactactttcttccacaaaatccgacgattcggtaactgtaacaccttttaccgatagcaggttgttattttgttcttcgttatcactagaaacgaccacttcctcactcatgtttaattttagtactatcacagaaaccacaaaacttaatactgatacttaatcaccttttacaacaccaatagcaattagtaactacattgcattatgtatttcactgcaccagtaccacacctttgtgaagttcctcgcgtagtacctatgtacttcaaaataagtactaaaatgtgtttaaaaaatgctgattgtcaatatacttcgtaagcgatattt

SEQ ID NO: 150 - DNA, 731 bp, Diabrotica virgifera
  Annotation=Tollip-like protein
  SmartBlast Evalue=7E-92; Info=Tollip-like protein n=1 Tax= Sitophilus zeamais RepID=B6RQP5_SITZE
agatgctggtactggatatacagccattggtttaactggcccacctccagttctaggcaccaccataataggttgatttggtggataaatatttggaggggatgccgtgtaactaaggacaagatttatcatgccctctactccttctcctttgtttaccattgagtgggtaccaatcttcgtgtgtttccccacttaaaacctgtgcaggaatggtaatctgagcccaagctattaattcatccatagtaaaagatctctcatcaaatatttcaattgttattgtatttataccatgtggaaggaaacagtataccactttattccatcttggatttttacttccatttggatcagtgggtgtttcataaatagaatgtccaactctaattctacagtaaggatccattctagtcatgccatagttctttgccagcttggcctgagccacagttatactaagacgtcctgctggattgtaaacataggacatggtcccacctgcataatgttgttgaagagctattgctgtctgcctgtcagcagcttcttgttgttcctggattgatgtatttacccgcagaaaatcatcgggtaagggtcctagaagaactctatttcgtttatctttaaccttctctgatactgctgaagccatgactttattcagatttgtaataacttccataaataataagattcctcatcaatacaacaaaatattgcccaac

SEQ ID NO: 151 - DNA, 909 bp, Diabrotica virgifera
  Annotation=Complement component
  SmartBlast Evalue=6E-70; Info=Complement component n=1 Tax= Aedes aegypti RepID=Q1HR26_AEDAE
tttatctcctcctatctcccaatttaccggctacattcctaaatttattatcaaacatgaacaatattttaaaagtggcacaaagactgaatggcgtcagatcgttgttgaatccaatcaaaaatgggatatcctcttcaataaaccagcaaagacaaattgcccgatctatttggtatatgagtaactctcaaagaaatggaatcatcaaagaagtcgagcacactcaattgtgcagctgtggatgtggtagtaaaagagccagtcataccaaagctgagaaagaacttgttgaatttttgacagaagaaatcgtagcagagaggaaagcacaaaaaattaaaaccattccaacagagttaggtggctttaaagcaaatttaaatggagcggaaataacattaacaaagactgcaggagacgaaaccatcaaactaagtttcaatgtaaatcacagtgtggatagtgatgttgagccagaggtaaacgaaaatatggataagcctgatattggagaactgaaatccaaaccttcattcaaagtagaaatagtaagaggaaatacaacaattagtttgctctgttcatacatgaatgcaaatgaacaagatgatggatacaatgacatatttggcattgatgaaatcagcatttatgaaggagaatggaatgaaaatgtatactcagtttcaggagaagttttagatacatacttgtatgatttattattgaactacttggaagaaaaaggaatctccaatgattttgtagaaaaactctcgaaatatagtacaacatatgaacactcagcatatattggtcttctagaaggattgtctaaatttgtgtcaggaaaataagaaatgtgctaagataaaaataagtataagtgttatatttcatttaata

SEQ ID NO: 152 - DNA, 2330 bp, Diabrotica virgifera
  Annotation=Protein tyrosine phosphatase prl
  SmartBlast Evalue=6E-72; Info=Protein tyrosine phosphatase prl n=3 Tax=Culicidae RepID=Q17K23_AEDAE
ggccctccaaagtgtactagtaccttaaaagaaaaattagagctcgccgggatagtctataaaataccgcacggccagtacaagctgctcttgaagaatggaacaacctacaagaacaaaatgttgtcaatttgactaggagcgtgttcacgccaattgaactttgcataagggctaagggtggtaacactgacttatactagtttcaatttgttattacaagactttgttcttttatttatttttatgtattggggattaaattgctttaaaataaatattgtttgacttcgtatgttggttttttaaaactcgcttgaaataataagaaatatcagatgattctatataagtttgattgtatgtacacatttcatttttgtggtaagcaatatgagaaaacctcagttgaaagctagtacgaataggattcttgtacaatatctacgtacatttatcttgtcgtgtgtttctctttttaaatatattcacttgatataagaaactttatattgcgactgactttcacatattttaaccttcttacgcttcgtagatatattgtactgaaagtgagtttactacagctgtagtaaacgggacgtgtaactagggaattgactgtgctttactaattatagcaaaccctttgatctaatgatgaaagtgaatacagagatgattaaattttcagtttactacagtaacactgaaagaagaaatatctgcaatgtgagatattagacaatacaattgaataagtcaactgcaggaaatcttccacagaatcatcaccaatgcaggtaaaaaaaaataaataaacgaaaagcttggcttatcttattattttttagggtcaattcatggacaataaaaaattgctcaataatggacctacttagtgcgttgttggtgctatggagatgttaagtaaaaattaagaaaatattggaacaagatccagctaaaaaaatcacataggttataggatcagggggatccagacaggttaagcttctaatttgtgaacaacttgtttcagctcaattatgattatttatattttattttaaaataagcattacgtatatttaactctcatgagaccgaaataattattttagtaagtgccctgtcgctatttgaacacatattaagagagatattatttactgaacgcagcaagagttcttgtggccattcttggattttagtctggatttgggacggtatttctccagaaatgctagttgtttggcatttattgcacctctccttttttctctaatcaactcgacagcctcctcatatttaagtccgagctcaataagagccagagccaccatgacaggagctcttcccaggccagcgatgcaatgaacggctacgcagcaatcgggattgtcattgaactgttttttaagaatcttgaaccattcatcgactattttagttggcggaaaggtgccgtcgtcgtagcctaggtcgaagacttcaatattctggttgtttagctcctccactttgtacgacggttcgcacactctcacaacggccgttacccggtgttttttcagctcctggatgtaacccacgatggtctgatcagcaggtctatcggtgatgaggaatttgaatcctttgtattcaatttctgctgcagcaggtctaagatctttctgacgcatggctacagggattccttgtccttgagaattatgattcatgccccgacgtacacgacttttctttaaatatcacacaatttttagaagaccgacttgatgatctccaaatatatatttaaaaataaaaactagttaaaagatcagtctttttaaagaaagttactgttttttcaattgtttacaattgcaatttatttacactaggttgatatgcttagcaattgaaaggaagaacgcaacaaaagtttttagtgcagtttgacggatgagaaactcagaatgacatatgatgtactaatttggcgtcttgaaggatgaggtcaaattcaatatctagttagctgtgatgaaaatgactaattcgacggcagtcggtatgcctctttttattagtaatttatttgtgttgagcttggcaatattctgcgctatccaaatggaactccatgtatgcgagcactgtctcaccaaaatactctttagccatacacattgaaaatgcaattgtcaggataatgtctcagatccacaagaacgtggataaaacaccaacacaattttacactatcacttcaccaaagcgtttcgctttagtactacaactacaggatggttcagctcagcaaagcaagatggtcctca

SEQ ID NO: 153 - DNA, 1238 bp, Diabrotica virgifera
  Annotation=StAR-related lipid transfer protein 7
  SmartBlast Evalue=3E-57; Info=StAR-related lipid transfer protein 7 n=1 Tax=Camponotus floridanus RepID=E2A196_9HYME
ctggttctattgtatttaatgactaactgagttaataaatagtttgagacttaacacaacaacataatgttatataaataaagactttcttacctacattaaattaaaataaaaaattgcgatcattgtagcaaacatcctaatgggagataatagtgctacaagaaaataaagttttagcttttttactacctcccaatactttcactctttatattttcctttttaggcgatacaaaatattacagtctcttaaaaatcgactacgttattgtttaattactgaaagaaataatacaaaggatttaaataattatatggactatcacgtttagttgaattgtttgaattgtgctgtacgctactgacttcactagtatcggtatctttaacattacctgaagcattctcgttccctctagcattttgttcctcgttttccggcattaatatactcttaacttctctgaagtaactgcaataatccaatttgtctttctgtctttgggcttccgctgctcgctctgctgcgacaacagcattacacgctttcgtggtaccttcttttaaacagtagtttttgtaatgtttcgtagcttctctcagtttctctaaaaactcaggcatggcacgcatggcaacccaggttgttaccgaggatggtatactcacgcctgggttgtcgtagtaggtcaagacgaactgtattcctggcctcgtcatgtctccttcatacggtttgattaccatacacgaccaatagtcgtctatccgatatttttctgcgtattttggaaactttggatgttcggtgctccggtttaggatgaatatagtgttcaatgtgttgtctatcaagtaacgtctgttaaagacgtaatctcgattcacaaacagcctaggccataaaagttcccagtaaatgacatcgctgttagaattcttcaaaggatcagactctgcgtgttcaaggataactgcactcgtatcccacttcctcctatagtcaatatcaacttgaacattcaaaaaatcttcggctgacacatcattgtaagtaccatacactttatattcgtattgacctgatccagaatggtgaagtcttctccagattaccagatcgggtttttcgataaataacacccagtcatcgtaagttttggaatttgagtgtgaccgcattcgcatatatgtgagctggtgccgtttggtgttttcgttgtgtcgcaagctag

SEQ ID NO: 154 - DNA, 938 bp, Diabrotica virgifera
  Annotation=ETS translocation variant 1
  SmartBlast Evalue=4E-36; Info=ETS translocation variant 1 n=1 Tax=Harpegnathos saltator RepID=E2C703_9HYME
gtgccgcttcacatataccacaataaaattatcgaatttagtagtagtaggtaacaaacgtattcctaacttctgaatttaaattagaaacaaccaactcagttagaggaagtcgttagatcgagttgtatgatagttgctatcaattgctggttaatcaagcactatccacttattattttaaacctcgtgtagcggcttttttataaagagtaataatgtccgaaaacaaacctgatacagttcctggactaggatttaaggataaagataaggcattggatacattaaaaaatttagaaggaagagatcctgattaccaaagactttctattaaaggattgataggaagagcaaaaagaactctgacattaacaaaggacaaagagaagatccaaaacataaatgatgccgtcaaagtatttgaggacttcctaagggacttcgaaatcaacaatatgtcaaaagaaaacagagcatacctgcctcttgcctcagttcaatcattactacctctaaaagaaaaattcgatattaacgatgaattagtagaagcatttttagaagcatacaccaagaaggccaaaggcgaatataaaaatctcagaactgtgtccagtggtgaaggaaagccctcttgggacatagtaagaaatgtggaaattaagaagttactaaaggccatggaagagagtcgtccagatatgtggaaagacgatttaccaaccaaagaacatcttgagctcatattgtgggcttatagtccagatgcaagtaaaattaaaaagaatgttagtaattacgaagaaaaattaggatctaaaaaaccagatagctctgaagatgaggagatggacgacgacgatgatgatgaggaggaggaggaagaagagaagcccaagaagaaacctgaaaaagccagcaaaagaagatcatcg

SEQ ID NO: 155 - DNA, 1059 bp, Diabrotica virgifera
  Annotation=Peroxisomal biogenesis factor, putative
  SmartBlast Evalue=3E-52; Info=Peroxisomal biogenesis factor, putative n=1 Tax=Pediculus humanus corporis RepID=E0VLZ5_PEDHC
caatcaaaatcatactatgaaaaaaaaatagtgtttgaaaactaaatttttattattaactattttttaattttgcaaaacatgagttgtacagttaccattttttagatttgtaaatacaattagtttgcgattcgtagttgtaaaatcagcgtttaacatgactgtgttttccaaagttcaaggatttatttcaaggcacaggaacaagttttacattgggggtgctattatctcgggatctattttattaaccaaatatgcccagtataagcttagggaatggcaagaaagggaaaccaaggagttcttcgacagaaaccgcaaacaaaaccattttgagagcatagaaagaaccaaaagccaaacattttctaattttgccgtggctctattagatttaatttcagatacagtaaacacagatgaaattattgaacgtcttaagacaaatccagaaaacaaagttgaactatggaacaatttaaaggtattggtcatgacaaaagtagcagtcactgtctattccttagtaatgttagctgttactttgaacatacaacttatgataattggtggatatttatataaggatcccaatagtatacccacagatgtccaagaaaagtatttggcacattgtcaaaattttattaatgaaggggttaagaagttagctaaacttattgacaatgaggttcaaaaatatgttggtaatatggaattaacaaagcagctaaaacttggagatatagaaaatttaaactggtctgtacaagtagctttatcttcacaaagggatggtccaattgaatcttttaaaagctttatattttctacagaagaaactagtggtgatagcattatatatgacaatatgttaagagacactgcagacttcctagatagtgaagaagtaaagtcactcactacccgttgtatcaatcaaggattcattttactgggagaccagctggcagaattgtatacaaaaggtaacatggctggagatgccagtaatagcgacgaatcatttaaaaatccttttgaattacagaa

SEQ ID NO: 156 - DNA, 616 bp, Diabrotica virgifera
  Annotation=Ribosomal protein L12e
  SmartBlast Evalue=3E-80; Info=Ribosomal protein L12e n=1 Tax= Scarabaeus laticollis RepID=Q4GXJ3_SCALT
gtgaaaatattttcactattgtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgattggaaaggtcttaaaatcacagttcaattgaaaatccaaaatcgtcaagctaccatttctgtagtcccatctgcttcctccctgatcattagggctcttaaagaaccaccacgcgataggaagaagcaaaagaacattaaacacactggtaacattactttcgatgaaatcatcgctattgccagacagatgaggcccaggtcgatggccaaacagttatccggaactgtaaaagaggttttaggaacagcccaatcagttggatgtacaattgatggtaaagcagcacatgatgttattgacgaggttaatgaaggaaccatagaagtaccagatgaataaactattattagaatattttttctaagtt

SEQ ID NO: 157 - DNA, 1656 bp, Diabrotica virgifera
  Annotation=Cellular retinaldehyde-binding protein
  SmartBlast Evalue=2E-62; Info=Cellular retinaldehyde-binding protein n=2 Tax=Culicini RepID=B0W1F6_CULQU
ttaaaaaataacgtggtttattgaagttactagcctaaaataaataataatttaaacaataaaacaacaagtgcttgaaaactgttaggggtgatatattaaaaaaacatgatataaataaaattaaaactaaagaagtcaatgacaccactatgagtttatttaagtccttgtcttaaaatatccataatttttgttaatagatcacccctttcctgaataatatttagctaacttaaacagttccggtatcctttgttcgacattcactaacaaataattattatcacattaaagactctgctctaagcaacaaaaattccgctgtaacaatacattaaacagtatcaacatattatttattgtctgaatatttgtaatatcttaaaaataccatcgattcaataacattcatcgaaaatttctttggtaaacgttttcctgaatcaaatctttgctgcccgatcagctagtgtcatgattttgtttcaatctctcttgaagcatgtccaaaaacgtcctatggtcgtaactgggttcttcaccacctaactctgcaggcagaacgtctttatggacatgttcatgtagagtgctaaggttatttccatgcacgaagattctttccttgaccttttcgtttaagaaaggttttatgagagctaacgctgtttctacgtaccatggttgggctatgaaatggattcctttgaatctagcagggaagcagtcttgtagaccttctatcataagttttagtactgaaggttttaagtaagtcgactgtcggaaggtaaattcagtccagtctactattacaacgaaaccattggactggttgtgaacgtgttctatgagatgttccaatactaaaaggaacgctctgaatattgtttgaagactataactacaatcccagttgttccctgtaaagagtagtatacacctccctttcctatctttttgacgcagaacaccaggtaatccgttttctaaggacttctgtatatcaacagctgatatcgtcagattctcacatatctccggatgccgctttttgtacgacaagtaattcttcaatagggtataactgtcttcaaccataaactttctcgcatataagaatttttggatctcttgggtgtttaagtttttcatagctgcttttagttcgtcatcttcgcactggctgatcatgttcctcagggaaattgttgtttcgttgagcctttccttctgatccttatactttggtagagtgatcttggtgagatccaaagtgggatgacgtacactatactctatgaattctgacatgttgtctcaataatgttcacagcaacaagcacatactcaaattaagtgtaatgtagtcaaaaacaagtcgttccggctaaggaaaagccattttcacacagtaactggacacagaagaaccatctgtcacacgcaagtgtttgggtaccactaagccagggttctacctgaatgactcacagcggaacaccgttgattggaggtacctacgtgtatgtatacagtacggcttatttcacctgttcagtccacggtattaccaccgagtacaaatctacactggaggattattttttattgacttaacgagatttgggtacacctgtttgttgtttcgct

SEQ ID NO: 158 - DNA, 634 bp, Diabrotica virgifera
  Annotation=Switch-associated protein 70
  SmartBlast Evalue=3E-10; Info=Switch-associated protein 70 n=2 Tax=Gallus gallus RepID=SWP70_CHICK
acgattttctggtatatgttgtttactgattcttctaaggccacagtatcgcttatttcattcaaacatctggattctaggacagcaataaacggtgcaaatctaaagtttcccatagaaatactgagactggtaaaatcctcttcgtcaaagtagcaccccaacgacgacgcaatactttgagcaatattacaaacttctgaaggatgtaacaaaacttgataaacattttcgttgtactgatcgggtaccagttcagccaacacgcaaaaaattcgaaaaatttggaacatcgaatcgtcggaaaagattctgttgtctcttggtaaatacctcgttctgcagatcagccaacatacttctgcgattttactttcgaataaccttaattcgtgatgctgtaaggttttcggtagggaagagaatacctcttgttgtagataatacttaaactggttaaaatttaatactgatgtgctgcgaaagtgttccaggcctctttctactccgtaaagatctaagagtgttccaatattggccgtcagtacctttaactttgatttgtgtaccaatccagagcgatcttgctgcaacgcctcaaaagccagccacaaacaattagcagtattttcca

SEQ ID NO: 159 - DNA, 593 bp, Diabrotica virgifera
  Annotation=Helicase with zinc finger protein domain helz, putative
  SmartBlast Evalue=5E-69; Info=Helicase with zinc finger protein domain helz, putative n=1 Tax=Pediculus humanus corporis RepID= E0VGG2_PEDHC
gtagtgatcgtacaatcgttcgagtagagatatatggagattcctttctttggcaaacgtcgagaaaatatccggtcccaattgcatatgatcaccagcaagaacaatccttgtgctgtcatgagcaactgctaaaggagtaaccgtttcacattcaatcgcctgagctgcttcgtctaggagaatatgcgtgaagaatccttgaggaaggcccatggcggagagatataccgatgtagaaagagttacgacgattattttgtgcttcatgatgtcttccaaagtcggtatctcaaaagaccggtatgttccgttgtttttaatcaaacagtacttttgaactatcggatgaacagtagacacccaacgtttcgtgtagtaaatcctcagaggtctcgcgctctcctcaccgttttccacccactgatccaaataatctttgatatacaaatcggccgcgctgttcgaatgtgtacacaacagaatcctgttgggggagtctttgatgagctctctgatcgcctggctaaagtaacgttttccggtaccgaagggccgatgaccaagatcggtggtaattgaacacataacgg

SEQ ID NO: 160 - DNA, 1434 bp, Diabrotica virgifera
  Annotation=CG8315
  SmartBlast Evalue=2E-58; Info=CG8315 n=5 Tax=melanogaster subgroup RepID=Q7JZE1_DROME
cctgtaataccatcgaccgtgaggtcatatagatataaaaaataaatgaatcatcattaatggtaatggtttatataattttagaagtattactctaacatttcataatggtaatcgatcaacttataaaactaaacaaccaaactgcaggcagagataaaattgccaggctgctgcagtacttgagtaggtttgtatggcacaatttgcagaaaactcaaaaacatggtgtagtaagtctgaaaaatttggaatttcagttgagtactttcaggaaattactcagatttggaagatttgccgaaagtatatatacaacattaccattcttcgagcaggatgaagccactatacgctatactgtgattttaagcaaaattgccaattcgttgtttcttttggctgaccacatactatggttaggacgtgcagacgtgtgtacagtggacacggagagatggtcacgtctatccaacaagtattggttatattccataactatgaatttagttagagatttctatgaaatttctaatattttaaaaagtaataaggactcaattttacaaaataaattcagttcaaaggaaatgctacatattttgttacgaagcttttatattcttagtaatcatcaagatgttatgatagatactatcaaaaatggctgtgacttttttattcctttcacatcattaggtcatacaaaattatcaccagggattattggtttactaggggctgtctcttctattgctggattgctagtcttactacaaccttctaaaaaactcattccttcttaatatcgttaaagttattaggtgacagtccatttttattttgtaataaaaattatacaatgaatgttaaggtttgggtcagaattattaaagacttcgttttgtacaactatataaaacgaaagatttttggtaaaaatggtatgaaatatttataaaggcaaaggtataatttatttattgaaaatccaaaaaggtgcatttttggaatcattgtttataatgataaaaacgatagtgagttacttgcatgacaaattgtcttatttgtaggaaggttgaattatttgctggctgactataatacttttaaaacaataacaatacagagaagaagaaaggtcccagatacaaaattcattattaagataaaataacaaataatgatttaaatctggtacctttcttggaaccctttctggtaacatcctttatctctgacttttacaatttataagccaagagacgacgactaataaagagaagcgaaaaggattctacaatatgcaatcatatttcgtcttactcgtctaggaaaaggtcagaaagatagttccaatactcaacatctgagtaaacattttgtcatgttgtgtataacaccttgccagcataactctcaagtctaatt

SEQ ID NO: 161 - DNA, 882 bp, Diabrotica virgifera
  Annotation=Sorting nexin
  SmartBlast Evalue=6E-75; Info=Sorting nexin n=1 Tax=Aedes aegypti RepID=Q17CA9_AEDAE
attccgataggttgttggtgtaaatttttttgtataagttagttttaatgtaataattataaaaacgtgaataagaaagtctcgcgattatcccctacagcagtacttgtcctgtagatcataatgatggcggaagcagatgcaacggtcgaagcgaccagaagattaaatgtaaagaaacaaacgttggatgatgcttatgcggcaccagctaattttttagagatcgatgtcgttaatcctgttactacaattggggtgggaaagaaaagatttacagattatgaagttaaaatgagaacaaatctacctgtttttaaagtaaacgaatccagtgtacggcgacgatacagtgattttgaatggttaaggaatgaattggaaagagatagtaaaattgttgtgcctcctttacctggaaaagcttggaaaagacagctaccttttagaggagacgatggaatatttgaggaagattttatcgaagatagaagaaaaggtttagaagtttttattaacaaaattgctggccatcctttggctcaaaatgaaaggtgcctacacatgtttctacaagagcctcagattgatagaaactatgtacccggaaaaattcgcaatacataaattaacaaaagcctagctagaattccatccttgtctctactattttatttctattttattttatatgttatttcgtgtgcattacttctcatagttctagtttgtttgaatatatttgtatatttttctaattaagacattagatttcggtggttatattatatcaaattatttttaataagtataaaaagtctgttaaatttattgtgaactgacctgtttggtgtaaaaaaacactttgggatattaattatt

SEQ ID NO: 162 - DNA, 800 bp, Diabrotica virgifera
  Annotation=WD repeat-containing protein SAZD
  SmartBlast Evalue=1E-62; Info=WD repeat-containing protein SAZD n=1 Tax=Camponotus floridanus RepID=E2AF94_9HYME
attttgtgtcatgcggtagagataaagtaataattttgtgggaagtaggtaaaagtgagggtatcaaagtaatcccacaattcgaagcaatagaaacgataacagggttgcctttgaagtttaaggttcctggttttaaatcagaagctgatggtatttacgttgcagcagctggtgaaaagggtgtagtttgtgtgtgggatgttaaaaaggctaaacaagtctatgtccaagataattctctagtaagtaaagcttctgaagaaggtggtttatcagtagtattgcttagatgcaatcttaaagacaaagccttagctgttgtaacaactgatcataatattatcattcatcatttgaagtcatttgtatgtcttaagcaatttgtaggcttttctgatgactattttggatattacgtttgtaggcgaggaagattcacacttagctattgccaccaactcgtcagatataaaactttattgtaacgctaccatgaattgtcaaatactaaagggtcacacagatatagtcatttcattagctacttgcccagcagatccaacaaatatgctttcgtcaggtaaagataatacagtgaggctgtggaaacttgatggaaatatcatgaactgtatagctacaggttttagacatacaggttctgtaagttccgtagctttcagtcaaaccaattgcaactttggagtctcagttagtcaagatatgtgtttaaaactgtgggaataccaacgaaatcaaaaatcgcaagcttaaactgtatgcatactgtcttagct

SEQ ID NO: 163 - DNA, 812 bp, Diabrotica virgifera
  Annotation=Mannosyltransferase
  SmartBlast Evalue=4E-61; Info=Mannosyltransferase n=2 Tax=Aedes aegypti RepID=Q17HC4_AEDAE
cgacttacgaagggtgaggatgtggacgatgtgttggtagaggtgtttaaaatttatacgtgtaatttcctggtattcatagtttaaataacaaacaagatgttgcatctaagaaaaggtgtattattaacgctgtttatttatgtaattcatggatttcgtgaaatccacgcttcttcacaaaagtatgtaacatgtggctcggtggtaaaacttttaaatacagattatagagtaagactacattcacatgatgtaaagtatggaacaggtagtggacaacaatcggttacagggactgaagttcaagaagatattaacagtcattggttggtaaaaccagctactggaaaaagcttagaaagagggacgccgattaaatgtggttcgaccatcagattagagcatgtagataccaaaaagaatttacattcacatcatttttctagtcctttgagtagtaatcaggaaattagttgctatggagacaatggggaaggagattccggagataactggatggttatatgttcaggtgacagttggcaaagggatgaaagtataatgtttaaacatgtagacacagacatgtatctgtctgtatcaggtagaacttttggtagaccaattaatggtcaaatggaagtaattggagtacgctcatctacaggatcggtgcattggcaaacagctgaaggtgtgtttttacatgctccagatttatctgctcgacatatgcactcagttcattctgagctatgaaacaaacaattattagttacaggttttttaatttattttttaattttgtt

SEQ ID NO: 164 - DNA, 674 bp, Diabrotica virgifera
  Annotation=Prefoldin subunit 3
  SmartBlast Evalue=1E-61; Info=Prefoldin subunit 3 n=1 Tax= Harpegnathos saltator RepID=E2BY71_9HYME
attaattacaaattttagaataatggaaacagaatcaaatattactgaactaggagatagaaagtcctacgcgggcatcccagaagccgaatttgtggaagatgtagacgcttacatgcaacgatctgaaaataacagtaacgtagacgaagttttaaaaaaattagacagccagcatgccaaatataaattcatggaatacaatttattgtcaaagaagaaacggctactcaatcaagtcccagagttgaaaagatccctcactatgatagagaaacttgaggaggaaaaggaagagttcgaaacgcagttcctgcttagtgagcaagtttttgcgaaagccaaagttcctcccactgagactgtgtgtttgtggttaggtgcaaatgtaatgttggagtataccttagaagatgcgaaaaaactgttgactcaaaacattacggcagcgacgcggaacttgagctatgttgaacatgatttggacttcctaagagatcaatttacaacaactgaagtgaacatggcaagagtatacaattgggatgtcaaaaggcgccaagcattaaaagcaacagcagcaaaataatacagagacgtttttgatagaggccaatataataattgcattttctcattaaattattttatttttattaataaattaatattta

SEQ ID NO: 165 - DNA, 505 bp, Diabrotica virgifera
  Annotation=Mediator of RNA polymerase II transcription subunit 8
  SmartBlast Evalue=1E-62; Info=Mediator of RNA polymerase II transcription subunit 8 n=2 Tax=Aculeata RepID=E2AUJ3_9HYME
tcaaagtatgcagcaaagagaggaaaaacaacttgagtctgctttggacgcgattattcaaagagtaaatgatttgaagcagtcaatagcatcgatgatatttaaaattgaaaatgaatatgatgctattaattggccgacttttttggataattatgctttaatatcaggacaattaacatctctttccaaagtaatgagtcatgataaatgtccagtattaagaaacttgactgttttaccactaatgctatcgcctgaaagagatgaacaacttgcacaaattactgaacatagagtaacaacatttgctcatgacttagttcctgattaccttagaacaaaattagaaccaatggctgaaacaaaaatgatgcaattggaaaacaaggctttaagtttgcagtatgataatgctcagaaacaaattgcaacatatcagaaggtggtttcccatgtatgggatattgtgagtaaagcacgagaagaatgggaggttgagtca

SEQ ID NO: 166 - DNA, 914 bp, Diabrotica virgifera
  Annotation=Nuclear distribution protein NUDC
  SmartBlast Evalue=1E-45; Info=Nuclear distribution protein NUDC n=1 Tax=Biston betularia RepID=E3UKM0_9NEOP
aaatggaccactaaatggtgacccttcagcattccaagctttctttaaagtctcatgaacctgtaattcttccgtagttggtaaacctagcctttttctttcatgattccactgtaactcttctattttcacctgagcatgttccggtagttcgtcatatggtctagtacaatcaattgttgatatgtctagctctggttcgctttttattaaacaattccaccacttttcttggcatttatccaaatgtagcagcaactttcgtccatccagagaccatacagtatcagccgctttacatttttcacaaagatctccactcagtatatactcaccatctcttaactttactgaaatagagctcgactgaagttttacctctaaatcttttgtactgacatctttggggattctcacaatgacatcaatttcgtttatagactgcgaccagcaataatgctcgaagacagcaccgttataatattcagactttgaaaaactaaattcttccaccccatcttcaagtagttcatcttttgttgtagaggacacctgctggtctgattcttcactacaagacacgactacttcttctgtagatacaggtatttcattaggggtgtatatgacatctcgtgggacagctttccatttcaaaaatgtatgtctgactaacttttcagaaagaccttttggcaaacccaaaccgggattcatcatggacacattataaaagtcggtccttcttgccaaaaagccaaatatgtcatctaggaatttcggcagagttctgcagtctttgagcatttcaaataacatatcatcatgattattttcagacattgtttaatgtacctttaaaaaatattttgttttgtactatgaaatttattgatttatttacaaagatgaag

SEQ ID NO: 167 - DNA, 545 bp, Diabrotica virgifera
  Annotation=CG1812, isoform A
  SmartBlast Evalue=9E-23; Info=CG1812, isoform A n=4 Tax= melanogaster subgroup RepID=Q9VRA7_DROME
aaacatcctccaactatatacaattcattattgaacacggcggtgccaaagttacattgctctacatgaggtattgaggtaagatgtttccattgtctctccgaagcgaagctataggtgatctcgttcgtgatgccgctcattccaaaaccgccaatcttcagcaccgccatctccattcctcgagagttgaggagggacgagatgaagcgagattcttcgtttgtggtttgtcgatagacttcttggataatgattttgtagagctgccattcgcattttctgtcttcgaatactttgtcgagaatactctctaattttctttgggatatttcgacgaagtgaatgtatctaataatcctcaaggcgtaagtcaaccggattgctaactcattggtatctacgtgaaaaaaccacgtcaaaactatcctaagtacatcggcttcggaacagtccactggataatcgaaggcaagcaaattttctaactgctgcggtgtcagtctgtaaaactctgagctgtttgagaactccaacaaatgttc

SEQ ID NO: 168 - DNA, 974 bp, Diabrotica virgifera
  Annotation=Transmembrane BAX inhibitor motif-containing protein 4
  SmartBlast Evalue=7E-59; Info=Transmembrane BAX inhibitor motif- containing protein 4 n=1 Tax=Harpegnathos saltator RepID=E2C4P8_ 9HYME
cattaatgacactgacgaatagacgtagacaaataaatattagaaattgatcagaataatgttttaataattaataacagtttataaaaagataaaacttgcaaacgtcagtaaaacacatcagaaaaatgtcgcaaacagtgtccctaattctgaacgaagatgtcgaacatggtggaaaagaatacgacgaggatgatatcgaaaatgattttgcctacagaaacaatgtattgaacgctacaaaacaaataaggttagcatttattcgcaaagtttatggccttttgtccatgcaaatattactaacctttattatagccagcatatgtttgtttacaccacctataaaaagctttgttcacacaaatgactggatgatgatgttttcttttattgctagcattgcactgttagtacctctacacatcaaaaggaaggaatctcctaccaattttatccttctaatagcctttacagttgttcaagcttacacaatcggagtcatagtgacattctattcaaaagtagtcgtgttacaagcattagtattaacccttgttgtattggtcgctctgactgcattcacattccaaactaagcgtgacttctctgccactcattccgcgttattcgctggactctgcattctcatcgtaggaggatttatgcagatattcattcaatcgtctatattggaacttggtattggactcggtggagcatttttgttctgccttttcatcgtagtggatacccaaatgataatgaagactttgtcaccagaagaatacattttagccacaataaacttgtacatggatataatcaacttattcgtttatattctgcgtattttacaggagttaaataggcaataattcacttatttttatgtagcaatgaataaataaccttatccactttttagtagtaaattatttgtaaatattattggctcttacagtatttta

SEQ ID NO: 169 - DNA, 791 bp, Diabrotica virgifera
  Annotation=Alkylated DNA repair protein alkB-like protein 6
  SmartBlast Evalue=2E-59; Info=Alkylated DNA repair protein alkB- like protein 6 n=1 Tax=Camponotus floridanus RepID=E2APU4_9HYME
tttaaaataattttatttttaaaacttttggaacatttctaatagttaaagatatcctcgttgacctctccagttcttgatcacaggaatctaattgacaacaatctttattagcacagtcatttatggaatcaaattttctttctgaaatggaatgtaagtattttgaatacaaatcatctttaattatgattaaacttcttggttctaaaaatatattgcagactttctttcgactctcgtcatttgttacaaattctaatacagtgtgagaaccacatgaaatagtgcttattgtaggataaaaaagcggcccatcagaatgaggcataataccttgtccaggtaaatactcatttactaatacttgatttggtttacactgttcgaaaatttgtaactcagcaattttatttaaatatgcttgtaaccaactcggtattctttctggtatcattcctttttcgtgtggaatacctccataatcttgcaatcttctattagaaagactagtccattttggttttggaactgcatagacttgttttataatgtgtgattcctcgttatcagtgataaagtttggaatgtaaaaagctgaagcaggaacttcatttacacggtactgtgagacatccattcaagattcaaaacaaatataaacattgtaaatgtaaatgcctatcatgacccatcataaaatctttcctcagcacaacaacaaacaacattacattacatttttactttacattataactatattacattttcattttacatttcttctg

SEQ ID NO: 170 - DNA, 744 bp, Diabrotica virgifera
  Annotation=Mitochondrial ribosomal protein, L45, putative
  SmartBlast Evalue=2E-65; Info=Mitochondrial ribosomal protein, L45, putative n=1 Tax=Aedes aegypti RepID=Q16NB4_AEDAE
aataaaattaggttataatttttaaatgatgttttaaaaataatttttaatatagttaaataacaataaaacaatgactcttagaattactaatacactaggtttacgtttacttcaggatgtatgtcacaattttatggccccagcggcagttagtgctaatacacaaatagttagacataggcgaacgaaacattggaatcctaaatggaaactctttcgtcgtttaaaagttatgccagtggaattgcccaaattccaagaaagagtagaagatttaccagatgaggaagtagtgaaaagattaaaagagcaaggtatcctgcctccccgtccttggattgaacggcaatatttcattcattcaactggtgctatttttgagccatatgtaccaccagaaggtgacgggaaagtttcaccagtatctaaacagggagcaatgcagagtgtgcaatttttgcaaaagaaaacaactacaatgatggcaataaggaaagttcgtcagtttgaggaagaattcgacacaccacagttttgtaaagatgctgaaaaaatttatatcaaaatgcatgagattttagcttctgacgataaagaaaatcttatagactatgtcacagaaagagcataccccgaagttacccacaatattaaaaacaagactcttcgctggaaatacattaaagaattagaactaccaagagttgtacaggcgagatgtactgatgttgtatcaaaaga

SEQ ID NO: 171 - DNA, 1148 bp, Diabrotica virgifera
  Annotation=Myb-binding protein 1A
  SmartBlast Evalue=1E-57; Info=Myb-binding protein 1A n=1 Tax= Harpegnathos saltator RepID=E2BGF9_9HYME
ctttcgtttaaagcttccctaattttctccgtgtttgatcttaagtatctttgatttgtgtaaaatgaaaggaccaattccaagccttgggactttttgaaaactttaacgttagcgtcaaagaggtattttaaaattgtagttactaaagtaagattgccatcccaggaaatttttaagaggttcttaaaaaccagaaagggcgttgcacattctcttttattgaagtatgtgtccaattcgttccttattaactctactatggagtttttaagacgctttttttactttctttggtgtagcttcggcattggaaagtaaatctgaacacttgatcgtgaaaatgcaacagtgtgaaatctgttctctcatatcttgcacgatccaagtattctttgtccctttatcaagcaaactcttgagtagatcacacaagactgcgtcatctacaccatcagtgttttcaaatttcttcaaatttgataacttcttcaaacatgattttagtcgatgtaatagaggagcttggtgttcatctcttacgctgaattccacagtttttaacaaagggagcataatttctaaagtaataatcatcgaagggttggaatctaaatatatctcgatcaaatctaaaactctaactctgaaatgggttaacgttctctgatcttcattctgttttttgcgctttccatggttcggtctaaactgtttaaaagcatcagctagcgctttatccaatttttctccttcagtgtcactcatttgatcgatatctatgctttcttcatcactttgatacccgttagatgttaaaactttctgcaaagccattcttaacttgtcgtttgcactctcatcttccatatcattatcatcgtcgtcgtcgtcttcttcgttgttagaatcatcagactcatcttccttttccgattctgattcttcatcagaatcgtcttcatcgctatgattgtttcctttggataaaggattttcattttctggatctaacactgataccaattgttggattgtagacgttgtcatgttttcacataaatatggaaagaccaagttaacgatgtttctaagtaagtgagaattttgcgataaaaagtttaaaaatagatctgttaccacttcaa

SEQ ID NO: 172 - DNA, 708 bp, Diabrotica virgifera
  Annotation=Protein LSM12-like protein
  SmartBlast Evalue=1E-54; Info=Protein LSM12-like protein n=1 Tax=Harpegnathos saltator RepID=E2BLG3_9HYME
tacaatgatatgcaataaaaaataggatcttcggattgttttcttgaaaatcaaatgtaacagaggtatatcatacaatagatattataaattatctagatcttgttttaacttattgcaaattactgttctggcaaactccttgactctggttgtttaaggctaaatcgttcatgtgtttctcgaccactttccttatatatgtgtattctttactgtttgtatttcctcttatattttccaattggtaaggtggactaattataacatctcgattaaaaaccacaatttccgaatcgttccacctaacctcactaattgttttagctatagctatgaacaatctctgaccttcagaactaacattcgcagatattgcttgaaatattcgcctcttttcatctacttgattccgtactctagtgtttagcctttgtaaattcaaggattgtggtatttctgggccatttgtaacttccttcttgacttctaatttactaaccagggataaattaacaaaatgaatgtcattcagttttggatccccacttgtgggaatacattttagtattaatattttcgtttgtggatcgaatgccaaaacttctccttcgatttctttattataacaagttctacaccaaacaatacttcctaatgaaaaaaagtctgaaacagcagccatttcgcaaaatagaaatggcaact

SEQ ID NO: 173 - DNA, 570 bp, Diabrotica virgifera
  Annotation=Retrograde Golgi transport protein RGP1-like protein
  SmartBlast Evalue=1E-52; Info=Retrograde Golgi transport protein RGP1-like protein n=2 Tax=Formicidae RepID=E2AZ54_9HYME
gtggactttctttttttctgatttccaaaaatggattggcaggtgttaattcctctgtagtatcattacaaagagccacagcctcatttaacaaagtttcacaaagaggaagaaccctaataggcactcttaacaatttaacaggactattaactctttgtgtgcctattgttattttgtatgaatacttcactaactgacctctatatgatggaggggaatcgtttggaattttttctctatagatatatgtttttgactgtccaggggataatctcaaatcacaaaagagtatttttggtttcgtagctacttctactcttgcattttcattagtatgtacacccaaggcagtaccaggaaaattcgatatattctcagaggctctatctttgggaactttagaatcagtaaaacattggcagtggatttgggctgaggcccaagctaaactttcaaaaacatctgtgtggctttgggcaactgtatgtgaaggagaaggatgatgaataaaagttacactacattctaaggtttcaccagatagaaatacgtgaccatggggcaatt

SEQ ID NO: 174 - DNA, 953 bp, Diabrotica virgifera
  Annotation=Glucosamine-6-phosphate N-acetyltransferase
  SmartBlast Evalue=6E-65; Info=Glucosamine-6-phosphate N- acetyltransferase n=1 Tax=Bombyx mori RepID=Q2F694_BOMMO
aataaaatatttattagtgatgtagttaatacaaaaataactacaaaaataaaataaggtcccgaagcaccaatgcatccatagcaaataaaaaaatttaactatttgtaaaatttgattactcagtccaatgattgaatagtgaaaaaatattttaatgattgaatagtgaaaacatattttgatgaaaaccaataattggcatgaacatgaataagaacagatcagctaatttaaagttttgattttggggatgcattggcggctaattgtcaggatggatccactttttcaaatctcaacatcatcgagttggaatttcctggctccagtttatatccaagggacttgtaaaacgctatcagtggatctttgcagtctaaggacattttataacatcccaatctttttgctagtagggtaactgttaagacaatcagttttcctagttgttttcctctataagtgttattgacgactacatcctctaaacgtgctcgtaaagcacagtcatgaataaatttaaattctgttattaatgttgacgaaccaataatagtgttactcctggtatcttctatgacggttacataatatcctccagctttacgcatattccagaactggcgttcaaattcgagttttccaatatttccaacttcggttagttgagacaagatttgcagaaaacctttgtcgtaatcggatagttttaaaggtcttactacaatccatgattctcccggattgtcactacttatttcaggattcaaactagattgcacagaagtccaatctagattttttaataagttcggatcatacagatcctcttctccaatggaatgccgattagcacccattgtctaccacctataatttataactacataagtaaaaggtaaataaaacgttgccactttcaaattttaaccttgacgttcactttaaaa

SEQ ID NO: 175 - DNA, 678 bp, Diabrotica virgifera
  Annotation=ATPase family AAA domain-containing protein 3
  SmartBlast Evalue=1E-73; Info=ATPase family AAA domain- containing protein 3 n=1 Tax=Camponotus floridanus RepID=E2A7Q5_ 9HYME
ttgaagctaagagagctgaagcagaagaaaaaaggaaaatgttacaagaagaaacaaaacaacatcaaaatagagcccaataccaagatcagttagcaaggaaaaggtatgatgatcagttactacaacagcaaagaatgaacgatgaaaatttaagaagacaagaagaatctgttgcgaaacaggaagctatgagaaaggctactatagaacatgaaatggaccttagacaccaaaatgaaatgaagaaagtagaagctgagttaaaagccaaagcaaagatagacagagaaaatagagatattacattggagcaaatccggctaaaggcagagcaaaacaggatcactgttttggaaagtataaagacagctggttcagtactaggtacaggagctcaaactcttttaacagactggaataaagtacttacagccgcaggaggattatcgttactcgctcttggtatatattcagctaagggagccaccagcatcactgccagatacattgagtctagattaggtaaaccatctttagtaagagaaacatccaggttttccgtactagaatcccttaaacaccccatagaactataaagagtttaaaacaaaggtgaagatgcgctgtctggtatagttttagctccaaaattagaagaaagattaagagatgtag

SEQ ID NO: 176 - DNA, 640 bp, Diabrotica virgifera
  Annotation=Tumor necrosis factor induced protein
  SmartBlast Evalue=8E-55; Info=Tumor necrosis factor induced protein n=1 Tax=Aedes aegypti RepID=Q16HN3_AEDAE
gttcactaaccaatcacttaacgactataacagagagacaaaacgtaattttttattgtagttatgactgaaagtgcttttaaggccagggatatagggctgagggcccaaaagaagatcctttctcgaatggcggggaaaaacatagccaaggccttcatagacgatacgacggcttcacttttggataatttataccgactggccaaacaatactcagacaacaaaaaagaagccgaaaaactcataaagaacatcatcaagatcgtcataaaacttggagtattacaccgtaacaacatgttctccgaagaagaactaaaactggccgaaaaattcaagaccaagttccgattggccggcatggctataatctcattctacgaagtcgatttcagctacgacagaaactatatcgtccaagcttttactgaaagccaaaagtgccttgaaactatcgtctccaaacatctcacagacaaatctctatctcgaatagacagcgtgttttcctttttcgggaacgaccagttcctggattcggtgttcaagaacaactccgagtacagggaggctctgggcagggtggtggccgatttaaatcaagccatagacaatggcgacctttagtctctctatt

SEQ ID NO: 177 - DNA, 1838 bp, Diabrotica virgifera
  Annotation=Zinc finger CCHC domain-containing protein 9
  SmartBlast Evalue=6E-59; Info=Zinc finger CCHC domain- containing protein 9 n=1 Tax=Camponotus floridanus RepID=E2AAN6_ 9HYME
attatcgagacaatctggattgctactaccaatagttttcaatatttatattattctgcaagtgttcctgttgagcttggtatttgggacaatctttcttaagatgcgtaacatctccacatactttacatgatcctcctttaggatacagtcctctagcgttatcaggacattgcctagatatatgtccttgttcattgcatataaaacattgggcatacctaaaatcttgcccccttacaactttgcattcaaagtgagtatgttctgttgagccacatttgaagcatattccagacgcagatgttgcaacttgatctttattcaattctggacattctgataaattgtgaccagattttcgacagttaaagcatacctttttcttttctcgagcaaacgccttttcagctcttctcctctctagtttcaaagctatgtcaatttcacttcttggtagtcccttacttatcatttcccttcgcagcttttttaacctatcagcatcctcctttttgactggaaatccatctacatagtctacgtcaacctcctttccatttataaacatttttgtgggcaaaagaggcttctttcgttgatgttccttgccatcttttacttttgggaattttttatcaaatttttttattgaattgattaggtttctcaaactttttaaaatctttttgtttctcaggtgaattaaatttattatttttgttctctatatttttttcctttgaaatttctaatttccctgatacttcgccattttctacctttaatttctcttcttcttctttttgcttttgtaattcagcttttattctctttttcttttctacttgtttaattcttctttgttttttcttttcaatcttttttaaatctagttcagtcaaattttccttaataatcttcttaggttgattatcacctttctgttttttagactgatctttctttccctttttgtttacagtatgtttacttttgttttcaccttgatgatttgatttgtttacgttatcttcacttttgatttcaccttgagttttaagctttttcttatattttgtattttcgtcatcagattttcgttttttagattgttgttccggtttctgtatattctcatctttaggagtaacactttctattttattggaacctttttctttttccctttctttattttagctggagaagttaaaacttccactttggaactttgctcatctggaggggcatcactatcttcattctcttgagaattactaacttttgtttttggctcacttaatatcttatcaagtttttctttcaaagctacaaatgtttcatcattatctgataactcatcatccatattggtattttcatcaaatgatgtgtcatcctgctcagagactgatttattttttttctttttactagattgactttgatcaacgttttgaattaccaaatcatcagtatttgaaaatgagtttttcttccttctagcaaatgttgatggggtttcgcctggaaattctgcccactcttcatgtttactttcctcctcttccttttgttctaaaaaggctctgtaatttgcattgcgctgatcaacagccctttgcctgtttttcttttcagaaatttccttatctttatctaataattgctgtttcatttggttccagggtgtagcttcttctggaactcgttcattggatgcttttgagccttttgcccttgcaaatcgagtcatattaaattataaaagagtatttaattgctaaaacactgttgttaaagggaaatgtagacagaccaaccagacacatcac

SEQ ID NO: 178 - DNA, 768 bp, Diabrotica virgifera
  Annotation=Prenylated Rab acceptor protein, putative
  SmartBlast Evalue=2E-60; Info=Prenylated Rab acceptor protein, putative n=1 Tax=Pediculus humanus corporis RepID=E0VSW2_PEDHC
gaaagagaagacgaacgaagtaaacacgtaaacacgtcaggacgtcagaacagaggttttaatttattttgtcttaaagacaattttggtgaatggtttaacttaatcctgagaaataatacttaaaaatgactgacatctcagtagaagtgtctggggaaatggatgcacctatggttaccccaaaaagcaagttgccaagctttcttcaacttccaacccagatgcccgatcccaaagaatggataagtcaacaaaggcagaaagtaagaccttggctaatttttataatgacttctaatttcaaaataccagtatcagtcccacgactcggcaaacgaatcatgaggaatatcgaatattttcaagccaactatttatttgtatttctaggactagtagtgtattgtctcgtaacctctccactcattctattggtaattgccggcacattctacgtaggttaccgcctaaacaagagacaacaggaaaaaccgctagtcctattcggcaaagaattaaccttagcgcagcaatacgtaatcgtaacgttatgttcactaccgatatttttcatggtaggcgcacacggggcgatattttgggttttgggtgcttcgatggtcgtgatcacactacatgcggcattttacaacattgaagcgctcgttacaagagaagacgattcctacgccttactggaagaagtttaactaaataagtgtatatttatgggaaatgtatataattttattattaatatctttt

SEQ ID NO: 179 - DNA, 597 bp, Diabrotica virgifera
  Annotation=Phd finger protein
  SmartBlast Evalue=4E-43; Info=Phd finger protein n=1 Tax=Aedes aegypti RepID=Q17KV2_AEDAE
aaacctttagaagctagtttaaaaaatgttttggattccatacatgcaaaggatactaacgaaatttttactgaaccagtagatcttgaagaggtaccagattatttaacagtcgtaacagatccaatggacttaagtacaatgaggaaaaagttagatgctggggattatccagacttatgtgctatggaaaaagatttcgatctcatgattgctaactgtttagcatataataataaggataccgttttttacagagctgccattaaaatgagagatcagtgtggactaatattccgacaagctaaaaaagagttggaaacagcaggccttttgccaactgtgaaagaatctaaacaaaaacctggagtagggcagattgaagaatctatggcttcggatattgataaagagcttgaaaatttacagggaaaaacaggtcctgatgttctaacgaaactggaggatctacttgtaaaaagccaagctttaaagcatggactagctagagcaaaaagggttaagttggtaagaagtgaaataaatagggctaaaaagagtttagcgtctcaaacagataccgatcaaacttctact

SEQ ID NO: 180 - DNA, 639 bp, Diabrotica virgifera
  Annotation=Mitochondrial ribosomal protein L17
  SmartBlast Evalue=6E-63; Info=Mitochondrial ribosomal protein L17 n=1 Tax=Aedes aegypti RepID=Q17FI8_AEDAE
ataacctataagtacttagtaaaaaaatatataaaatactaactaaaatgaatcaagcagaagttacaaaactagtttctaaattaaaaattagggtaaaccctaggttaagaaaatttagaaatcctcttggacccgaagagaggttaaacaagctaaggaaaaccgtaacggcgctaataaaacatgaaagaatagaactaaattatcccagagcaaatgaatcaaggatgtacgctgaaaggttaatatctgatgcaattcgttatggagactgtcacaaaacaactatggagatggcagactactggttgacagaaaaacaactaatccacaaactctttaaagtgttagtttccagatacgaaaattacaacataggctacactagattggtaagagctcccaaacttaatggagaaaccagagagcgagctgtattggaactaagaggtaacccatatccttccttgtggccagagaataattcaaatcgagatttacttcataatgtgttactagatgaggctaagaaggcatacaggatggaaaaatataaggaaattgctgctaaggtagaagaaaatatcaaagacagtaatcaaagtattgcaggtgcggaaaaagctaatgtagata

SEQ ID NO: 181 - DNA, 613 bp, Diabrotica virgifera
  Annotation=cAMP-dependent protein kinase catalytic subunit, putative
  SmartBlast Evalue=2E-50; Info=cAMP-dependent protein kinase catalytic subunit, putative n=1 Tax=Pediculus humanus corporis RepID=E0VA86_PEDHC
tcggacttttcattgtaaccctgtaaattttgttcaagcagttcaggacttaaccagtttaagtttttttctatagacctagggaaagaatggatcgttctctgccatctaccattttttacaatgggacatgcataccgcataccagttaaacaaatttgtcctgtaactgaaactaaaatgtgactagctcttatggctctgtgaatataaccttttttatgaatgtatactaatgcagataatacatcttttataattaatattatagcagactccagtagtccttcattaaaatgtctagttaacaaatctctgcaagatccataagccataagtggactaacaacacaaacttcaggacctgacacaaaagctgtaatatatggaagaatatttgggtggctaagttgtctcgttaatataatttctctctctaacaattttatatccccgggaattttgtcaacattaaatttcttgacggcaaccataacacctgaaggaaggtgttttgcaagttgaaccacagctttattatcgaagcattgccccaaaattgatattgtctggtattctgaaatgttggctttataggctgacattttagatt

SEQ ID NO: 182 - DNA, 1438 bp, Diabrotica virgifera
  Annotation=Tab2
  SmartBlast Evalue=2E-75; Info=Tab2 n=1 Tax=Tribolium castaneum RepID=D6WVD1_TRICA
atgtccaaagttgggttactgaaggccgaagaagaatgcgttttattcactttgtaaatatttttttgccggcaccgtacattatattgattatttcattcctaaagattctgactaatagaaagctacaagaataaaaatgaattataccattacgaattgttgccgttacgaatcgacggcgttacgaactgtcgtcgcgttacgagatgtcttgtctcgataaattagaactaaacttgatttttgttaataaaaattgtattaagcatactcggcgctgaatggctggtgttaatctgcgttggcatgctaatgctaggctgctggtcattttcttggttaattacaaatccgatcggtctcgtggcttgttccctgggaacgttattgagactgagcgatctagaagtacggccgatgtcaatgttgttaagcatgcgcaaagtaccaacggttatgttaggattaatagtctctgcttttttcgtaccgtgcaatattctcgggaagtcacattgctcacatttatccaatatcgggtggttaaggaatgtacataactgacagttccacttgggaccttcgaattttgggggactggtcggttgcagttggtgttgcagacgtcgtctggggttctgccgcagtcttggaatcggtatagaaaactcgtttataccctgtcctgtatatatgttgttgtaaaatgcttcaccatctaactccaagtcgttacactgaaaccgaagatgtttaatttctttgattaaatatttctcaatttctgcatttttctcactttcaagtctacttttctctaattcttgaatttcttcattcattataagtaatttagccttttctgagtttagttctattcgtaatctttctatccgtgcttgctgctttaaggctaatggagggtccgtattgactgacaaattattaagagatccagctctcactgaaaccatttgttggtgatgttcttgtggatgataacttttcggtctaactcggagtgaagatacacttccattgctaggccccacagtaatctgtaatcgactctgtagtcccttttgtgagtcgtaactactagttgaatacgtcaaactggaattttgtgatgttatatcgattggattggattgagcactagaagtggggggtctcaatgtgagattaacactggtaaaactcctcggtgacgtaggtacttgcaaccaaggttgagaaggagttacttgtagtgctgttgtacgctttggttgagttggactttgtactacgtctacagaacagttgacattcaaggagaggtttacgttttgattgcctattaaggtatctgtagtttgggtaggtgtagaacatgtttccttttttatattacctactaactcagtattatgctgcccttgcaattcaagag

SEQ ID NO: 183 - DNA, 1137 bp, Diabrotica virgifera
  Annotation=Polyadenylation factor subunit, putative
  SmartBlast Evalue=3E-21; Info=Polyadenylation factor subunit, putative n=1 Tax=Pediculus humanus corporis RepID=E0VX68_PEDHC
gagtataattttatattatttttcaaatcagatacaaaactacaataataaataataatagtaataaatacttattgttaataagtttacaacaaatattaaccatacaactaacagtttaaaaaatgttaaatacatgtcttataaatattaagaagtaatccagacttctattccacttgaatacgaacaatatgcccatcttctcctccggcatatatttcaccatcccttccaacttctatggcgttaacaatgataccagcatcaatagttgcttccagtgtgattgagttattttctattatccactttttgatattcttgtcccagccaccactgaagatgatgtttttgttgttccatcttgctcctgcgagtgagttgataatttttgtgtgggcaccctctgttttagctatttgtttaatatgtccagaatcactgacttcattaacgacaatatccgttgcttctttggtaacgtgagctacgtattttcctcctattaaagtcaaaggaaatgtaccgcctagtgaatcctttactccaaactgaatatgttcaccttccagtttaagatcagttacaacaatacccatgtttgcagtaattaagaggttcttaaaaataaccatgtccttaactggttcgcagatatttattgatccataaagtgttccatttttccatactttgacaaatccttcgttatctccagaatacaacactccattaactgatcgaactctccaatattctacttcggaattgtggagcaggactgacttcttttccaatgtatccaaagcataagaatcgacacttccttcgtttgaacatgagtaaatacaattgttatcgcctgccaagctgtataccgaacatgaattggcttttatctctgattttttagtcagatctggcaaccagcatttgatagttccatcatcagctccactatacagcttcccctcattaaacaataaacagttaatatcatgttcatgtttatcgacatcatcagctcttgaatcaattctcagcggcatcttttctgcagacgcgtaacgctaacaaattaaaagaataataattaaattggtaacagcacaactggtaactttacaatcgaac

SEQ ID NO: 184 - DNA, 1153 bp, Diabrotica virgifera
  Annotation=Vacuolar H+-ATPase v1 sector subunit E
  SmartBlast Evalue=3E-68; Info=Vacuolar H+-ATPase v1 sector subunit E n=1 Tax=Glossina morsitans morsitans RepID=D3TLB1_ GLOMM
gttgacagatcatatgatcagttttgagcacccatttttattgagcaaattgttcagaaagttgctgggcgtagtcgggaaaaacattgtttaaatccctttaatttcctctaagtcgaaagaaaaaggctcaaaatggctctcagcgacgcagatgtacaaaagcagatcaagcacatgatggctttcattgagcaagaagccaatgaaaaggccgaggaaattgatgcaaaggctgaagaagaattcaacatcgaaaagggccgtctggtccaacaacagaggctcaagattatggagtactacgagaaaaaagagaagcaagtagaactccagaaaaaaatccaatcatcaaacatgttgaaccaggcaagattgaaggtattgaaagtaagggaagaccatgtacgtgccgttttggaagatgctcgcaaacgtcttggtgaggtaaccagagattcaggcaaatatacacaaatcctggaaagtctcatcctccaagggctctatcagctcttcgaaaaggacatcaccattagagtacgccctcaggacagagaattggtaaaatctatcatgcctaacgtctcccaaaagtacaaggacataaccggtaaagacgtaaatctaaaaatcgacgacgagagccacctttctcaagaaaccaccggaggaatcgaactgttggccttgagaaacaagatcaaaatcaacaatactctggaagcccgtcttgagctcatctcacaacaattgattccccagatccgtaatgctctgttcggacgcaacgtcaacagaaaattcactgattaagtattttttggatactgtgtattgcctgtattttatatagtattgtaaaacattgttggttgcttagacagatcttcaaaaaccttttaaactactatgtatatacgatatatataataaaccattcctttttttgaagtattttaaacagttaagtttgttgttaccctaattgtatccttgtcaagcagatattttttaaaatccttagaaaattattaggtttcagttatactaccttatttttttctcaaaatatattcatatttatgtttatatgtatataaaaaattattttttcttgtgagaaatcatcgcaataaaatttattgttagt

SEQ ID NO: 185 - DNA, 624 bp, Diabrotica virgifera
  Annotation=Methyltransferase-like protein 10
  SmartBlast Evalue=1E-49; Info=Methyltransferase-like protein 10 n=1 Tax=Salmo salar RepID=B5XB96_SALSA
aaatacacaggatgttacaacatttccaactttacccccaaattgaaattgaggagtaggaataatagcaaatcgactaaacttattactaaattgttcatctaattcactttgtgtccaattacaagatgtaataataaaaactcctccatccataaggcttctgtacacattctcgatgtatttttcccgattttctttgggattttcacttaaactaatagcatcataagttcccttatcgtgaaccacatagtagttttctggtaaaccttctaaaatatcacaagtaagatattttatatgtaagttttgtttgtttgcaatttgttgtgacagttcgacagcatttttagaatagtcaactcctgttagatttgtatatccttcattcgctaattcaaccaaaagcattccattaccacaacccaaatcaattactttgctatctttctcaattagatcacttttatccatccacctaatgactctatctacagtatcctccccaaaccaaacctcacctggatcaccatgactagaaaaatttttaatttcttcggcataccgattttcccaataatcttggtttcctaattcagacggttccaactcatccattga

SEQ ID NO: 186 - DNA, 685 bp, Diabrotica virgifera
  Annotation=Dihydrofolate reductase
  SmartBlast Evalue=5E-51; Info=Dihydrofolate reductase n=1 Tax= Culex quinquefasciatus RepID=B0W600_CULQU
tttctcttcactttatcactttaaccaacctttaactttaaagtaaattaaagaaactaccaaagaagagaactataaaatgaatcatgaaaatatagaacctcaaaagtgctgtcccaatgataaaatgaagctaaaaatcctagctattcatggttaccgacaaaacgctgaaacttttagatcaaaaactggatcttttcgaaagatgattcacaaatgggcagagttcacgtacattacagctccccataaggttattctagtagatgatcctaatgatttagagaaaaatggacctgatattggacaaagtaaagatgaagaacaatatggttggttttttaatcgagatgataaaacatttaggggtattagaaaaggagggccagccattggttttgaagatagtttaaaatatatagaagatatttgtgaaaaagaaggtccatttgatggtcttttaggattctcacaaggagcttgctttgctggattactttgtgatttacaacaaagaggattgtccaaattcacttttaattttgccattttttcttctggttttaaatctgggagccttccacatttgaaatattacatcgacagaataacaataccaagccttcatatttttggagaaaatgatcagatcattccaacagacatgagtgaagctttgagt

SEQ ID NO: 187 - DNA, 601 bp, Diabrotica virgifera
  Annotation=tRNA (Guanine-N(7)-)-methyltransferase
  SmartBlast Evalue=4E-72; Info=tRNA (Guanine-N(7)-)- methyltransferase n=1 Tax=Camponotus floridanus RepID=E2AU15_ 9HYME
caaaatgtgttagtaaggttagaatggttcaatttttaaactttttgtatgttttaaattttaaacagtaataattaaatagaagctataaaaaatggctgaaaattcgacagtacggttgccccagaagcgattttataggcaacgagcacattccaacccgatagcggatcattgttttgattatccccatgctccagaactcatggactggagtccattttatccagaaaagtttgtagacaatgagaataatccccagaaaatagaatttgcagatattggctgtggttatggtggcttactcattactttatctcccatgtttccacagacattaatgttaggaatggaaataagagtaaaagtttctgactacgttatggacagaattactgcattgaggtcgcaacatcctactgagtatcagaatgtagcttgtctaaggtcaaacgctatgaaatatttgccaaattttttcaaaaaaggacagttacagaaaatgttcttcctatatccagatccacacttcaagaaagcgaaacataaatggagaatcattaatcaaaatctcttagctgaatatgcttatgttttatca

SEQ ID NO: 188 - DNA, 761 bp, Diabrotica virgifera
  Annotation=Thioredoxin-like protein 4A
  SmartBlast Evalue=3E-71; Info=Thioredoxin-like protein 4A n=34 Tax=Coelomata RepID=TXN4A_HUMAN
atcacgacaacgaacattttactgtgcaaaatatgaagaacgaaagtaaattgcaaattatattgttctttattgtagtaattattagatcaaaatactttcttacttcttatgttgcacactaaaatattcgttgtcgcgacaatccaaaacagtcgtatatttgtggaatacgaatacaccatatacctagcttattaaaagtaaaagtatagtatataaaagtaaattaatatctatatttagtggaataatctttagggtgacactaccaaacccctgcctttcctagcccccctatacactgtctccactatatctatcatctcctgtttatcctcaagcggccaattaatcttattattgttaccagttcccaaatctatcataatgtgcttgtttctaaagaagaacatcactgtacatggatcatacaattcgtacattttattaaagtccggcacttctgtgatgtctaccaagtaaatcactgcaaagtttttcactttttctgcgatactgtacaacacttcatccattttcatgcaagaagggtcccaatcgtgcccgaatctgatcactaccactctgtcttcctctgagagtatggcttggtccacttgccagccgttgtgtaaatgagctaacatatacgacatcttgaagtattttaattacttatcgtcaaatatattctatattctcaatgaatttattattaaattaattagaaatacaaatagaaatctactgtttatttt

SEQ ID NO: 189 - DNA, 517 bp, Diabrotica virgifera
  Annotation=Flap endonuclease 1
  SmartBlast Evalue=1E-70; Info=Flap endonuclease 1 n=1 Tax=Aedes aegypti RepID=FEN1_AEDAE
gtaaaagcaggaaaagtatatgctacagctacagaggatatggatgcacttacatttggctcaaaggtcttagtaagacacatgacatttagtgaagcaaggaaaatgccaattcaagaaattcatctagataaagttttaacaggattagatttaactcaagaacagtttattgatctgtgcatattattgggttgtgattatactgatagcataagaggcattggtccgaagagagcaatagaattgattcaaaaacacaaaagtattgaaagcatcatccaaaacatagacaaagataaatacccaattccagaaaattggaattatgaaggggctagagaactcttcaagaatccagaagtgtcagaggcagacgatattgaattaaaatggggcgaaccagatgaagaggaactagtgaaatatttatgtggagacaaaaatttcagcgaggacagagtgagaaacggggtcaaaaaacttatgaaagccaaaggcggatcaacacaaggca

SEQ ID NO: 190 - DNA, 741 bp, Diabrotica virgifera
  Annotation=6-phosphogluconolactonase
  SmartBlast Evalue=5E-56; Info=6-phosphogluconolactonase n=1 Tax= Aedes aegypti RepID=Q16H01_AEDAE
tgagttgtcaaatcaaaaaaccagttcaaaaaaataacctatcaacaagtggttcaatttaaaatttgaatagaactttccttcctttttacaataaaaatgactgtgatagtagtagaaaataaagataaagttatagaaaagctttgtgagctgatagaacgtgcagcaaaagaaagtattgataaacgggatgtgtttttaataggtgtttctggcggatcactggcagtattccttgaagttggtctacctaaaattaagtcagatttttcaaaatggaggctatttttctgtgacgaaagagttgtacctgtagataatcccgattccacatatggactgtacaagagggctctggtggattcggggctgcttggcttaaagccagatcagtttgtgcagatcaaacaaggtgttccagccgaagaagcagccatcgattatgaaaatcaactaaaaaaattctttccatctcaacaactaccccagtttgacatgctattgttgggtatgggtccagacggtcacacctgctctctatttccaggccacccactgttatcggtcacagacagatggattgctcctatcactgactcaccgaaaccacctccaagtagagtgaccatgacttttccagtagtcaataatgctagagtatgtgtttttgctacaggcggtaaagagaaagctgacatgataaagaaagtactagtagatcaggatgaacaacttcca

SEQ ID NO: 191 - DNA, 458 bp, Diabrotica virgifera
  Annotation=Mediator of RNA polymerase II transcription subunit 19
  SmartBlast Evalue=1E-66; Info=Mediator of RNA polymerase II transcription subunit 19 n=4 Tax=Apocrita RepID=E2B310_9HYME
ctgcaactttttgataaaacaatgaagtgaaagatgatgggagatcagtttcggaaagttgaacaatattctccaaaatcgtcgccaagaggggccaggtcccctgtcgtatcacgtcaagattcttcgggaacattaaaaacaacaattttgctaggaaagaatccctccatagtccctagtggacctttctatttaatgaaagaaccacccggagaatctgagctaacaggagccacaaatttgatgacatattatggcttggaacattcctatagcaaattcagtggtaaaaagttaaaggagcagttatcttcatttctacccactttacctggtgtcatagattccccaggacaacaagacaatagttccttaagatctgttatcgaaaaaccaccagtaggtggtaaggagcttcttccactatccaatatccaattagatggatttcgact

SEQ ID NO: 192 - DNA, 722 bp, Diabrotica virgifera
  Annotation=Putative microsomal signal peptidase 25 kD subunit
  SmartBlast Evalue=1E-60; Info=Putative microsomal signal peptidase 25 kD subunit n=1 Tax=Cimex lectularius RepID=D1FPM8_ CIMLE
cttattgaaaaatataaaaaatgaaataatttacacgtcaacttcttttagtaggtagtctctgtgtacatcattttctttcctctcacttagtagagaattgtgcattttggtgatttcatcttcaacattttctttaactacagttccttgctggtctatgtacctggcaatactccttttaatactctgctctcttctttggcgtgtttttccatcaatatatgcaagattcaaagtatacttatcatcatacttttgaatataagagctagcttcccaagtattttccttcttagaactatctttctgaatacaaacagcaaagattcctttctctttgtatgtagtatataaagttaaaattcccatcataaaaaaatatgtagtaacagaaaatattaaaataggcttagattgtgggaatgggtacaaataatcccaaatcaaggcaaacattgcaacacctacagctatgccacatataactaacctaccatccatgagagcaaaattttcagcataattgtatttctttgtaagtacctctttaactgcatcatctaatgcatttttgacggctactccatcccatttatttattgatacgatttcatcatctttttcctttggtgccatacttaaaaatctgtattaattattaaatatagaataaacagctgtggaaacaacgccgaccactgtaattttttaatttaaag

SEQ ID NO: 193 - DNA, 538 bp, Diabrotica virgifera
  Annotation=RNA 3' terminal phosphate cyclase
  SmartBlast Evalue=5E-52; Info=RNA 3' terminal phosphate cyclase n=1 Tax=Culex quinquefasciatus RepID=B0WYC5_CULQU
tgactgagacgtagaatctaccacgccgcccagatatatctcgtataataatcgctgcgctgcagctattcctaggtcttctggtacggaaggatcttcattatttgctacaacattggaaacctgttctgctgaataatgaactccctcagttgtttcagcaactaaatgtattccaaatccaggactatttccagattgcttccccctacattgatctgtatttatataaacatctggaataaaatttaagagaacacccttcgctttatctaccattctgttagctatagcaggagacactcttaaggcataggctgtacctcttatccttttaaccattccattcttcaacaattgaacaggcctcgtctgttttcgaactgggcatctgaatgttacttcacctccccccagtggcctcgagcccctcttggaaattttcaggtctaaatcgtcatcatccaatacgaatcttttcaatgtttgaatcatagacgtttttatgaggtctactgagggatctatattattggct

SEQ ID NO: 194 - DNA, 589 bp, Diabrotica virgifera
  Annotation=Ral guanine nucleotide dissociation stimulator-like 1
  SmartBlast Evalue=1E-51; Info=Ral guanine nucleotide dissociation stimulator-like 1 n=2 Tax=Formicidae RepID=E2C840_ 9HYME
atctagctcagtagaaggtagatattcttcacagaagtggagcagctgacgaagggcaggatgattgggcggatctttgaagtcttcagggtaactgtccagccacacgtgtaacgcagaaattagagttttccgatgttgttcgtgataatctggcttgccattgggcgtcgtttccgacagttcggcatatctttgcagcagcaatttgagtacttccttaggagtagaaaagcttctgtacgtggccagaaacacgttgatgtaggtcgtttccagttctccatcatcggtggaaagagcctcgactagtttcttcaacgttcccgctttgacgaaccgtactcgaacggtttcccattctaggtgggaaatttcgtcgtcggagtccgagtgtgaagacgacaaactcctggtcggtcggtggtaacgaactttcttgaggtaaaccgtgtatagggcgccatctgctttctcctcgccccacaatcgccatgtgggagtttcgaaacagtaacacacaaaattagatgaaagactgtcttcgcagtagcatacgaaagtaggaccgcaatcaaatctcattcca

SEQ ID NO: 195 - DNA, 597 bp, Diabrotica virgifera
  Annotation=Cysteine-rich hydrophobic protein
  SmartBlast Evalue=5E-48; Info=Cysteine-rich hydrophobic protein n=1 Tax=Glossina morsitans morsitans RepID=D3TPA9_GLOMM
ctgacaatcaaaaatgtcgaatgtaatttgttgatctacattttttattacaactagattaattcttctaattttaataataattttatacataataggtcaaataaagatgagtaatcaccataatggtgctagagctggtgaaactgaacaaatggcccaatcgcaatgcttgaaagtgttcatccaacgggattacagtgaagggactcttgtaaaattccaaaatagatttccacaagaacttgagggaaggctggagaggcaagcttttgagactactgttaatagactgaatgcattttttgcggaagctgagaaggctacctgtaccacatactgcgaaggatgcttagcatgtttaactgcatatttaatatatatttgtaaagaaacccattatgaaaagtgtttaaagaaggtatctaagtacatagcagaacaaaacgagagggtatatgaacccagaggacttaaactgacagaccccagcctgcgaggtttgagagtactagaaatcagctgtttagatcgtccgccaaacgcatgacttacattatcccactccacacaggagtttttcatgtgaaactcggg

SEQ ID NO: 196 - DNA, 1957 bp, Diabrotica virgifera
  Annotation=WW domain-binding protein 2
  SmartBlast Evalue=1E-61; Info=WW domain-binding protein 2 n=1 Tax=Camponotus floridanus RepID=E2ABL0_9HYME
catatattcatgacatcattactcataaatacatcgataatttttccagaatttttacaataaataaaaaattaactagtgattttgtgcggcaataaaaaaatatcgccaaaatgtcgttaaatacggcacatttaaacggaggagtgctaatccataatggagaacagattttattatattcagacggtgtaggcatagaatggagtggtcaacaaggaaatgccttctatggagtcaagaagggctctatttatctaacaacacacagagtcattttccttaacaaatctagtgcggatgagatgctcagtttcagctttccctttgtaacgctcagtgaggtcgagatagaacaaccagtttttggagccaattacataaagggaaaggttcgagcgcagccaaatggcaattggatcggtgaggccaagtttaagatgaccttcaagcatggaggggccattgagtttggacaggctctgcttagggcagcacattttgcctccagaggtggtggttacgatgcccctcctccatatgttcctcctcagacccagtggtatgcagctccacctccatcctacgctgctgcatcacaaggctattatggttggatgcctcccaccaatgtattcccacaacatccacctactgatggtgtcttcatgactgatgctcccccaccatacccgggaatagtacccggctaccaacccaatggctatggacctccacaaggcccccctggttattcccaaggaccaccaatgtatcctggaccagctagttatggcggtcagagttctgctggggcagctggttttcaacaaccaccacaatttgctagtgccgcagatgccaaagctcatgaagctgctcaatcggcctacaataatcaaaatagtagaccaccacagggttatgctcctcctccaccagcctattttgaaagtccacccacctacagccaagctacctacaagaaggatcagtaagcacttgcaggcgtactggaagtgagcacagaatgcgagcttttgcaaatatattatattattatttttaatgtttattgagaattttagttaagttcactttgaagtgatgtataggatgagacattcctcaaacacagcacattaaatatatttaatttagacttttgatcaaacaaaatggtactgaagtgatattttgtcattgttgtgtaattaaaggaaggaaaatataattttattctcattaatatgctgatgtttacaaactcgaaaattaaggttatattcctggacttctttctttgactatttacttcataaaactactttaaatctaacggtgagttttttctctttgtaatgtttaaaaacatcatttaataagtattttgtcgcaatttttatttaccatttttaccgtttgcgttgttgacagattgtgtcattttcaatgaataccggaaaaacaggtttttagcgcggatcttttatccgattgtttagagttgggttaatgtttctaatattttatttctagatttttttataaattacttctatagttcaagtcacagtttagtactggtacagaatgttggggctatttcgttgctgtttaatcattatcttgtactaataccatataggcctaatactcaattcaaatctgacgtgagctaaggcagccttcaatcttgtttggttttgtacctaaattgattctaaaagaaaaggctagcgctccttgtcgcatgtacaaaaggaaagaagttgagtttgtaaacgccattttactatataactaaactatgtatgttgttatcccgcatttattaaagtattgtataatagcagtaaccacttatatgtatatataaatattcaatactagcttatattgattatttttgttgagatgaaggcgtgtatatttcaataaaaacatcgttacaacg

SEQ ID NO: 197 - DNA, 585 bp, Diabrotica virgifera
  Annotation=Ribosomal protein L21
  SmartBlast Evalue=7E-72; Info=Ribosomal protein L21 n=1 Tax= Chrysomela tremulae RepID=D1M820_9CUCU
cgttgacagcgacatttcctccgccatttccttttactgtgtttcttaggatttggaaggtacaaaatgaccaactctaaaggttaccgccgaggaaccagggatctatttgcccgcaagtttaaaaaacgtggtgtaattccactttccacatatttgagagtctacaaagttggagatattgtagatatcaagggtaatggtgcagttcaaaagggtatgccccacaaagtgtaccatggtaagacaggacgtgttttcaatgttactgcacatgcattaggtgtaattgtaaacaaaagggttcgaggaagaatcatccccaaaagaatcaatctccgtattgaacatgtaaaccactccaagtgtcgtcaagacttcttgcaaagagtaaaatccaagaaaagctacgtaaagaagctaaagaaaagaacgttaaagtagaacttaggagacaacctgcccaacctaggccagcacatattgttagcggaaaggttccagcacaggtgcttgctcctatcccatatgaattcattgcttaggtttgtttatcttaaaataaaatcctttatataataaaaa

SEQ ID NO: 198 - DNA, 739 bp, Diabrotica virgifera
  Annotation=CG8768
  SmartBlast Evalue=4E-52; Info=CG8768 n=14 Tax=melanogaster subgroup RepID=Q8T0N5_DROME
tcttagtaccggtgcataattttaattatgcaatatttctataagtaaataattttggcaaaatgtcagctactggcaatattctagttggtggaggaacggggttcataggcaaatccctttgtaatctactaaaacaaaaagggtatggggtaactgtgatatctcgaatgccaggcattcacaggatatcatggaacgaattacaagaatctggtcttccaaaagataccaaagcagttgtgaatctagctggtcaaaatgttatggacatatcaagaagatggactgcaggtttcaaacagaatgtatttcattcaagagtaaatactacaaaaacattagcctctttaatcgataagacacatgaaaagcctaatgtttttgttaccatatcaggagttggggcctacaagccaagcacgacatcagaatatactgaagatagtgtcgtacaaccatttgactttttttctggattatgtcgagactgggagaatgctgcacaattaaatgataataaaacaaaatgtagattagctactattcgaagtggtgtcgttttaggtagagatggtggaatgataaaacaattgtatctcccattctttttgggattggggggtccagttggcagtggttctcagtttatgccatggattcatattgatgacctaacacatttgatcctgtttgctattgaaaatcccaaagtggatggcatattaaatggtgttgc

SEQ ID NO: 199 - DNA, 623 bp, Diabrotica virgifera
  Annotation=HEAT repeat containing 7A isoform 2
  SmartBlast Evalue=7E-14; Info=HEAT repeat containing 7A isoform 2 n=2 Tax=Murinae RepID=UPI0001A81EEC
ccgcaactgttgaagtatctggagcagaatttagaaaacttcaacgtcatagagtggcacgatttagtgtttgattttttgaatattctgctggaaacgaccagcaatgagtcctttaacgaaatgatcgttgtaaatgccaagaaacaactggagatgtacagtaacacaagatacgttgcgagccaaaacggcgactatcaaatcaaacaatcagaaaaacagttcctattgaaatgccttgctatagctttatgttacctcagagacaaagagtccgtcatgcagaccttagattctatcttgaacaacgtcaaattgacggattacgcggaatcccagacgtgcgcagaagcagtaggcatttgctcgcgaacgcatttacagttggtgctcgaaaagctagctacgattagaaaggaggtgctcacgaagaaatcctcaaaatttctcaacttcttaaaggaccagaaacacgaagtggccttggaccgtttgcgctacacagtcctttgcagttacgcgcaagtgtgcaacgaagctccgtcccacgagctcctgcaggtcatccagagcgagatcttggagtatgccgtcggggaattggtgaacagtaaggattt

SEQ ID NO: 200 - DNA, 1337 bp, Diabrotica virgifera
  Annotation=Peroxisomal biogenesis factor, putative
  SmartBlast Evalue=4E-50; Info=Peroxisomal biogenesis factor, putative n=1 Tax=Pediculus humanus corporis RepID=E0W135_PEDHC
aaatgtgattctgagagaaattaatgttttttaatactctaattatatttttgtaactagttaattgcattttattaagtacaaattgattattcacttacacacagcaatatacgtaggtgtttaaaattataaggtttagaaaaaccacttcattaatatcacattaattgataaggatataaattattaatatattattaaagtagtgtcaccccatttcctacgtaatcacaatgaccgacaaaaaggaggatgtaccaaaaactaacgtagatgaagaactatcgaatctcttagacagtgcattggaagacttcacaaagatcgaagctactcaaaaggatgccaagactgacacctccagtaaagaggttagtacttcaaatcaaagtgccaacattgagggtcaagagtggtctaacgatttcatacaacaggcggcgaatcagttcgaagaaaattttgctaatttcctagctggagctgatccaaatgcacaggtcacacccgaatttattcaacaaaagttacagcaaatggctgatgcagctcaacaagttctcgaaaaccctactcaggcagctgataattccgtggactttgcatcatctataacccaagccatacaatctttaaatgctggagctgaaggacttcaggccccattgaacgaggaagaactaatgaagatgttcactggggataaaactggccaagaaaatgatcttttaccgtttatgcaaggtatgatgcaaggcctactgtccaaagaagtattaggaccaagcctagaagattttgtacagagattaccagaatatatcgaaaaaaataaagatactttagataaaaaagatatcgagcgatatgagaaccagaagagactcatggaggaagtattacaagagttgaataaagaaacagaagaagatagtactgagattaagacagagaggtttagtaaagttttggggcttatgcaaaagcttcaagattatggacaaccccctgctgaactagtaggagatttagaaaccccatttagttttgatccgcaaggaaatcctatgaatttccccaatccggctcaagctaactcagaatgtaatttaatgtagatatatatgatagatgttttgtttttattgtgttaaaaatgggataatggaagatttgtactggttaccaatatgttactgttttaggtaatatgtattcaaggaatccaataaacaatcataatactttactcaaattttgtaataggacataatatgtgacataatatatgtttgttactttttgattactttttttgttgaaatatatcttcg

SEQ ID NO: 201 - DNA, 2694 bp, Diabrotica virgifera
  Annotation=Tumor protein D54-like
  SmartBlast Evalue=1E-46; Info=Tumor protein D54-like n=2 Tax= Stegomyia RepID=Q5MIP5_AEDAL
atttattgtaaaagtggcagcggcttgcggctagtcaatatttgtcattagtgtcaagttttattaggaaaatacccttttgtttttttcaccgtttttattttctgtgagtgaggtaatacattttatcaaaaatgaacaacattagccccacagcagaagaagccatggcagcagcagaaaccccaattccggatctttcccacttgtctacagaagaaagagctgagcaggaaagattatggaaagaggaactagccacgatagaagatgaaatctcgacgttgcggacagttcttgcgtctaagatgcgcagaagtgctgaactaaaacggaatttaggcatcactgtatggaaagaagtaacagacgacattaatcaaggaattaagaatgttaaagaaagtaatgtataccaaactgtagaaactaaagttggtcaagtaactaaggctgtgacagatgctcctatatatcaaaaaacttcatcacttctaggaggcatcacgggaaacattactaataaaataggacaaatgcggcactcagaatcattcaaatctttcgaggaaaaggttggatctgcatatgaaaatgttaagaccaaggtagcatcccgttctggttctcagcacagcttagacgaagccggcaggtcgcggtcaggttccacagttacaagtccaacaattccagaagataaaccattggcgtaggacactaaatttctacttaaccatcaaacgatcacatcagtacgccagccgatatgccttgataaaaagcttgtccaagaaaaaatacacatgcgtttgatttatttaatacctagttgttactatttttatcgccaattctatacctattttatcgccttagctcggaggtttatgtaatgttatattctagttttgttaaggggtcaaattgcatcttgagtatttaaattggcctaaactagtaattctaaaactactgtaagagcgttatcacactaggttgctttggcaacgtgttcagaagcttcgcagcagtgtgacgtaatctagacatgccagatgtgacggcagcgaaatacgaaacaactcaatacattttgtacattgctgtgaatctctttatagctttctacggagtggccagaaagttcctttcccaattttcttgatttgcggcatctgaattaaaaactttaaataaaaacaccagtttggaggctcaataaaaaccaggttttttttactaaaaaaaaaacaacagttggtttaaaccaagattttaagcatgttggtttaaacctgctaaccctggtttgcggacagtaagagtaaaatggggtggagagtcatattgttgaaaataaacagtgtgagcagttccctgaactctcaagggcggttcatgcgatgaaacgccgtcaaacattgggcacgttcaccagaacgttcaattttgagtgcgctcagcgctttgaaactgtttaagctttttctggtcaatgtcactgaatttaagctaaacttcaacgttttgacaaagccgtcgccattttattcagcgtagatttacatcgcttaatatagataacgtgtttaggaaatttattgtaatggcgcgctatttgaaaatatttacttttacaatagttttaattataaagtacataattgaaactaaggagatacataattgtatatgctcacgaaattgtaaatctgtgtattaaggaacaatattttcaacataattcatatttctcgtgacattatttatttctttctaatgggaatacatcatacaatgactctgcctagtccagcacagcattaacagcaccagaaattatttcttgttcattatcaaacaacaataaaggtaaaatattatccatgtttgaattaaatttgtttgacacgtccaagttatcgttgaacgatagttataaacaaaaacaacgaatctcgttttaggttaagttcatagaacaggtgagaatacaaaacaaaaccaactatcagtgtcaaacggaaaaataccattcaccagactgaaacgtagttttaaagcgctgaaacacagctgtttagtcgaaacgtaaaccgagtattactggtgaacgcggccattggcgcggtgttgacacattattattactgtaaagggattttccagtcaccctatagatatatctaacatagcttgataaactgttaaattcatataaaatgatatgaatataagataatcgtgtgaacaaaactcatcaaagcaaaagagaaatttatttaactaagttattatataataactaataacagttattggttaaaggaatataaagagaaagacctcgaaatgcaatgttctatttactaacaaagaaaaaagcaattatccgtataaatatgcaatctattcgataatttcacgaaaagcaggttgcaaataatttattttatattgatctttttgtatgtcattgataaagctcgaccgtcattttacatgacaatggctgcagatacgtgagcattcataaccttcttaatagaaggaagggattttttacactgtaaaacagtgccttctttattctgcttggccgagctcctggccacgctgctatagcagcctactgttataaatatataaaaaaaaagtatcggatgtaaaattttattaataaaaatgtgg

SEQ ID NO: 202 - DNA, 904 bp, Diabrotica virgifera
  Annotation=Zinc finger CCCH domain-containing protein 15-like protein
  SmartBlast Evalue=1E-69; Info=Zinc finger CCCH domain- containing protein 15-like protein n=3 Tax=Aculeata RepID= E2C872_9HYME
attgggacctaaagctgccctctccttttctataagatcttctagagtaatttcatttgctttatcttctagtttctttttatcctttttaaggacaaatccaggtggcaacgcatgtctgtaaatgcacccttctcctgtgggacatgtccagaaccaaccatactttgacttttctactgcttccaaaaagtgtttgcaaataatatcagtagttggcatttttcctttctctccatgtttcttttctatcacttcctttaatttagcttcatcccaattttccatagtgtcattgtcatcttcatcatttctcatatcaaaatacaatgaacgcttttctgcctttctttctactgctaaatcatgagagaatttgcatttgtcacctttgccacattgtccttgtttaaagaaggcacataccacagacttaggatcagcacctttatctattttttgtatctggactggtttaaatagagcagcaagttctttctgttctttgagctttttctccttctctaatttcttttgatctactgctgttcctagcggatgaataccaccggacttaacttgtttttccacttgttggataaatttttgctgttttgctccttttttatttttcaaaccaaaagttttatcttctataactttttccttctttttttgctcagtttttttgctgggagcacctggttttggtttcggaggcatctttgcagagctaaaattcttctaaaaatcaactaggtggttaaggttaaatacaatagtagttgttacggctacaatttaaagcggaagaattatagaaacattaataaattttaaatctggatcagaatgtcatgcagtcctaaagttgacaaccagttatttcaccgcatccacattg

SEQ ID NO: 203 - DNA, 948 bp, Diabrotica virgifera
  Annotation=CG7864
  SmartBlast Evalue=7E-43; Info=CG7864 n=5 Tax=melanogaster subgroup RepID=Q9W0D7_DROME
tcatataaaattctgcaaaaatataattctgctagaattaacttcttccctacaaatgggacaatttttctggtactgtaaactctcatatatacaattccaacaaaatatatgtccacagggggttgaacaggctgatttaatattttctgcgcataaaatacatcctttcttcgaagttactgctgacatttcggattctagagtgttgtaactgctacttggagtaaacatcttcataacaaaacttaataggacatagaataaagataaattacccaagatagaaaaacttcctgtaaaagtatcatcttccaaccattgtctcagtagtacatactgaattcctgtgactctattagaaatattgtaatatcttccatccatgtagaataatgcattgtgtatccttttaagtgttgatttttcttcttttagtattgcaatacacttcagtagcaaagactttacgtcactccttaaatcttggcttgctaaaatctttttcttggaataatttaatatcctatcgaacataggttctcctccaacgtgcagtatcaaccataaaagtgacaaagatttggaaggaatctgatgactagtattagatcttatagttccagtgtactcttcacccaaggtttgtaatttttccatagatgtcataaaataataccaaactcttgctatagtagaaatggaagaattcagcctgtgataatttcctgatcccatcaattttaaaaacagatgcattttttgttctgcatccattataaataattcgtccctttggtgcagccgtaatacatcggccactttagctttgtaaaacttcatgatcgaattattatatgtatatatgcatatgcatacacaaaatatttacaattattaactatttaactgattaaattaatgtttatttaccaaaatatatttatt

SEQ ID NO: 204 - DNA, 518 bp, Diabrotica virgifera
  Annotation=WD repeat-containing protein 47
  SmartBlast Evalue=2E-59; Info=WD repeat-containing protein 47 n= 3 Tax=Aculeata RepID=E2A5D3_9HYME
agtatactaaacgaattagaaaaatactcagcatcgaaagaagaatactcgacgatgtgtctactactcacccttccccgattatcggatcatttacagtacaaagactggaacccaagtaacgctagagtacagtgtttccgagaggtctatccattggtggccgaatatctgctgggtgataagaaacccactgacggaaatgctaactctagcgcccaaaacgacagactgattcaactcattattaaaggtatactctacgaatcttgtgttaattactgccaagccaaagcgacgggtagcaccgactcacaatcacaagacatgaatttcagtaaattattagacggaagtgtaggttttagtgattcagatttaagtttactttcgtggctgcaaagcgtcccctcagaaacgttttctgtcccgttcgagcaacgtaccctcaacgtggacgtcgagcggttggagagacctagtttggagacgtcctggactgagcatatgctgataac

SEQ ID NO: 205 - DNA, 1157 bp, Diabrotica virgifera
  Annotation=Galactose-1-phosphate uridylyltransferase
  SmartBlast Evalue=1E-116; Info=Galactose-1-phosphate uridylyltransferase n=1 Tax=Camponotus floridanus RepID=E2AJ65_ 9HYME
aaatacttttattattcaggcaaatctggtagttgattgttctcttaatagagctgctgccttttcaggcgtcaaatccctttgggcttgagccagcatctcatatccaaccataaactttttaacagtggcagaacgcagtaaaggaggataatatagtccatggaaggtccaatagggattgcactttcccaaatcttcacctgtcggtgctccgtgccaacccatagaatacgggaagttacatttaaataaattgtcatacttagcaactatagactgtaaagttaatgcaagtgcctctttctgcttagtatctacctctgaaaacctagctatatttcgttttggaagaaccattgtctcaaatggccatagagcccaataaggtacgaccactacccattcatcattttcgtatacaactctttctttcttctgtatttctttttggacataatcagctagcattggtctattatattttgcaaaatattcgcgtaagttttcatccttaactctggcttcatttggaagaaaagtggatgcccatatttgacagtggggatggggattggaacagcccatcatcgcaccccgattttcaaaaatttgtacccatttatacgttttacccaagtcattaagttggttaatccattcatttattaccgcgactacttcatccaacttcaaatttgtaagatatacattggaatgtggatgatagcagatcaccctacaagtccctttagccgccttagtttgaaacaggggatcatcactgggctccggttctggaccttcttccagtaaagctggaaaatcattggtaaatacatatgtagaggtgtatttgggagtcactaatccagaagctctagtaacaccaggacatagtggattagtgggatcaaattgtggaactacttctacttgcggagtctcaacttggccactccaaggtcgaagagctctatgtggagatactaagatccattctgatttgagtggattgtatctgaggtgctgatgttcgtctctgttaaatgacattttttctgtgctacaaaaacttaacgatcaataacactagagcaccattacgattaacacgccgcactttttaacctacaaacagccactgacaaacacaa

SEQ ID NO: 206 - DNA, 528 bp, Diabrotica virgifera
  Annotation=fibroblast growth factor (acidic) intracellular binding protein
  SmartBlast Evalue=1E-60; Info=fibroblast growth factor (acidic) intracellular binding protein n=1 Tax=Nasonia vitripennis RepID= UPI0001A46D47
ttcggggaggcaaaatgtacttttaatattctctgtcgttataccaggttgttcttcaacggttttgaatattctcttcacattgtcaaattgtcttctgcaagatttcaaaggtttccccgttttttcagcaacttcatctaaatctttcctatttttcgatgagagttttttacccaatacttcccgtactacctcatcatcaaattcgtaatacttttcaatgagaaagagtcgagtttgtgggtcaatctgaaatataaactgttcttgaagtttacttgggaagcttaaaagtttttcgagaagtgaataagttcggtaatgatccaatacatcactggcaatcagttctagagaagcgccagtttgttgacctaatcctttaatatttagcatcgatactgcttcactggcagtgtgcccgtctacccataattcataaatttctgggtcaactaatgtgtagttactaataaatacatcaacttcactcatattttgatgtttattacacaattcattacg

SEQ ID NO: 207 - DNA, 651 bp, Diabrotica virgifera
  Annotation=Synaptic vesicle 2-related protein
  SmartBlast Evalue=5E-53; Info=Synaptic vesicle 2-related protein n=1 Tax=Camponotus floridanus RepID=E2AXE4_9HYME
ttttttaggtcaccctcaaaatagacaaacagagtgggcaaatttttgtctggataattgggtatgcaagtggtagaaattgattttagaaacttaactgttgggtatttgacagctaaatgcttcatgtattcattgattaaggcacataggggtattccttgtttgtataaatgcaaaataacccatattccctctcctgctttattcacttcattgatgtagtcctgggcagatatttctccaacaaaaccaaacttctggcgctcagataaggctcttaactctgctatcctcttgtttctgtattcgagcaaaacagcttcatcctctgagtcttccagttcatctaattcatccaggtctagttcagacaaattttttccatttgcagttttcttttctatggtttcttctaacatagacacaatctgatcttcagtaatctctttttctttttgggggataatacccttagctcgtaggacatcattccattcagtatcttcatttggattctgcatatttatcaaagaaacttcacaactaattaaagaagagctgtataaaatagctagcacctaataacttatttcaaaaatacttttttaatctcgtttctctgctccaatttcaatatttatgattcat

SEQ ID NO: 208 - DNA, 514 bp, Diabrotica virgifera
  Annotation=Coiled-coil protein, putative
  SmartBlast Evalue=3E-38; Info=Coiled-coil protein, putative n=1 Tax=Ixodes scapularis RepID=B7QGU2_IXOSC
acttctttttaatttttggtgaagtagattgaaaaacactggatgccgacattaaattttctatatattgacccaacacttgattttcggaacgtagcttcaagttttcttccttcacggaatctaccctggttgaaagatcatccaatgtgttttgtaattcgagtacttgagaaataagtcgagctttttcttcttgttcatcagggctggagtctgattctaaactattatgttggggactagaacttccatttgtgaatgttgattgaatagagtccatgcttctaccgtgtatcatactggaagagtttccttcagatatcgagttttgttctggttcatcattgataatcacttgaggatcatcgtcagccaaaggtatattgttaatatcatcttgcagttttattgaagacattagtatgtctttggtacgtatatttagttttaaaaaataattgtcttaaattataaaggaattcctttcaattaaaatcaaccttattttcca

SEQ ID NO: 209 - DNA, 861 bp, Diabrotica virgifera
  Annotation=F1-ATPase chaperone
  SmartBlast Evalue=7E-59; Info=F1-ATPase chaperone n=1 Tax= Glossina morsitans morsitans RepID=D3TM47_GLOMM
ggctcattggttgaactgttccagaagcttcttcttttcttgaatcttcttgtacataatacatttgtagttgatttgccaaacattgtgcctcctgtgcatttataacattcttatcatattctcctctcataagcacaatccctttgtcaccttcaaattcgtcatagtgggtgatgtgtagacattcgggtgcattttctttatgaacttgatagtacagtaagggtgtgaaatgaacagtgttttgggcaaattgacacataataaactcatagccctgggtgcgaggaagggcaaagagaaaagttggatactttttggaattttcatttaattttacaaagtcccctgaaggaatagtggctgctatacaatattctttatgtttatggtattcttcccaaattgacttaatttcttctgcgtttttgtcctttattaaatctgttttcataatcttgtctaacgattcttgtttaaattgacctgtttctgccaacttttcttttggtgtcaacaattgggaatactgccgttctggttgcttgggaggatcaaatttcttcgtcttctggttagctttttcaatgcgggctttgaattcatttgggtcttctttatgtaatttggctattttttcagcatacttgtcataatagggattaccttttaagtcatccactacctcttgaaggtttcttggtgttgtcattatcgattttgtacaaattctaaaagatcctctatataagacagtgcgcattaaagacgttagatgcattttagaacatctagcatatttcagctaaaacaattttatgctgcagcaaattatttcaaaaattcaagaattcagat

SEQ ID NO: 210 - DNA, 687 bp, Diabrotica virgifera
  Annotation=NADH dehydrogenase, putative
  SmartBlast Evalue=8E-60; Info=NADH dehydrogenase, putative n=2 Tax=Culicini RepID=Q17JZ6_AEDAE
aaaaatatattaaaatcagctgctgatgctaatgtgaagttgagtttgacaaatatttaatttaatcaaatttaatttaaaaaggcattcaaataaactccttatttgtaaacatgccagaagacgcagctccacgaaatattcttgaaaaattcattttttctgtagcgaacacattagaagccccaactatatgggtgagagaaaagatcgtagaacccaatcaaaaacaatctgcctggtaccatcaaaagtttcgaagagtacctaccattgatgagtgctacactgatgatatcgtttgtatttcagaagcaaatatccaatttaaaagagacaagcttgttgatagtgaaatactaagcattatgagggaacgatttgaagaatgtacactgtatgaagctcctgatcatatagaaagatgtaaacctcttttggaacaataccaagaggcttccactaactggttcattaaatatggtgacttgggagcttatggcaatgctcatgatgcctatatgaaacaaaagcataggttgatttgggaacgcagacatggtccagtgggaggtggaatgaaaagtgctactccagcagaagagtaataaacacctgtgctaaatcataatagtatagggcaccaatttgtaatatattgtagttaatattaaaattttcaatgtt

SEQ ID NO: 211 - DNA, 613 bp, Diabrotica virgifera
  Annotation=COP9 signalosome complex subunit, putative
  SmartBlast Evalue=2E-42; Info=COP9 signalosome complex subunit, putative n=1 Tax=Pediculus humanus corporis RepID=E0VBW8_PEDHC
ttttcttgaattaaaagaaaagtgtttatatttgattagactgaattttaaattttgcacaatggtagtaaataacaacgatcaattagcagaagaattacagcgacaagaactagaggctcccaatggtatcgcagctcctcaggtgtatcaacaacttctagctatttatttataccaaaacgatttatgcaatgcaaagtatttgtggaaacgtatcccaccatcagttaaaacttctactccagagcttggtcacatttgggcagtgggacatagtatgtggaaaagagatttcccagccatatatacagctttgaatgctgttacttggtcagatatagtggcagatattatgaaacaagttcaagaagttgttagaaccagggctgttgatttaatatctcaagcatattcatcgatcactttagacacagtatctgcaatgacgggcttacctctagaggtatgcataccagcttgtgaagagaggggctggaaatatgacgcagaatcaaaaattgtacatccagtaaggaaagtcgtcgaatacatgggacaaactagtagcgaagatcaactatctaaattgactgattttgtttctttcttg

SEQ ID NO: 212 - DNA, 474 bp, Diabrotica virgifera
  Annotation=Arp2/3 complex 20 kD subunit, putative
  SmartBlast Evalue=8E-64; Info=Arp2/3 complex 20 kD subunit, putative n=6 Tax=Neoptera RepID=E0VA94_PEDHC
tatgacaaaatcgactaacttatgtttgtacatctgttctgtgtgaaaattggtaatgagaaagcttatatcgtatccttcaattggttttcttcgaagtacaatgaagttttcggctctcatcatcataaatcgcataaatttcttacagagaattttttcaatctcatctgcttgtttcactgctatactaattctaattgaatttactgatgcttctataaatactttttctttctcgtttctagatatcacgactgggttgagtagtaattctttggaagttgtaacctctacttctggtttattgtgccgttctaccacttgagaggaaaaattatctaaacacattgctgctgttaatgtgtgacgaactgctgttaaatacggtttcagagttgcagacatttttaaatgtttttatttttagttgaaacttttgtacacacggcaaatccaccacaccccaatgac

SEQ ID NO: 213 - DNA, 951 bp, Diabrotica virgifera
  Annotation=Elongator complex protein 2 (ELP2) (STAT3- interacting protein) (StIP1) (SHINC-2)
  SmartBlast Evalue=5E-53; Info=Elongator complex protein 2 (ELP2) (STAT3-interacting protein) (StIP1) (SHINC-2). n=2 Tax= Gallus gallus RepID=UPI0000ECCDEE
aaaaattgtccatgtggttcccacgcacagtccgttacttcgttgaagtgacctccgaccgttgcacaaggaatccattgtgataatttctcggagtgtttccatatgtggaaggcgccatggtaactgtgtccaaggactgtatcgccatctggtccgaacagtccaccataaaaaccagagtgttacctccaatttctcctactctaattttttcttagccataattctgaagtttcgtcgtactcccaaataatcatactcttatcaatggatgcagacaacagttgtttaccatcctggactccactgtacagaataaatccagccttcgtggccagatattacggattccaggtatacgttgaaggtgacggattttgttcgtaaccgggcattttcaagaacttctatacctaggttttttgtagatagacgccaaagccggatgaaggcgtcttgtgatgatgatgccaaaattaagtcatcgccatctctagtaaaatccaatcctcttacccaatcttcatgacctgccaacttggtagcttcttcaaaatgtaaattgtccgattggctttgagaaaaaatatgaattttggaatcatctagggcacatgctaataacaattcatcactatttggtaaatatgttaatctcagacttaatcctatatggaatccaaaattgagtgtttgatttaatacaaagtcaccttgataattttgtcttaaccatattttggcagtttgatccatagatacacttactacaacagcactgctatcatctctgtagaggccatctacaatattgacattggagctgtggcctttcagtacttctggctgatatatatcaccaattgaagtacaaatacatatcgtcccatcagtagatccagaaataatttcattttctttagtattattttttcctcttaaccattt

SEQ ID NO: 214 - DNA, 659 bp, Diabrotica virgifera
  Annotation=ATP synthase mitochondrial F1 complex assembly factor 2
  SmartBlast Evalue=3E-43; Info=ATP synthase mitochondrial F1 complex assembly factor 2 n=1 Tax=Camponotus floridanus RepID= E2APH0_9HYME
gtgaatgtgaaatagaattgaaatttttaaatagtaatatataaccatggaagttatcaccaaaggttttagaatacttaagttatcaactgaatctttacttagttctaaaagatctaggattaataattactatagacattatgccactccacccaaacgattttataaaaatactggaatattacgtagtgatggtaaatttgagatcacccttgatcaaaggaagttaaaaacacccaagggaaatatttttgcagttgagagtgaagctttagcattagcagtggcaacagaatggaattctcagaaagataaaattattagaagtaaaatgcatttgacaactctgtgtaataccaccatggacaatcctaataacttgacaaaatatgatattgccaattatattgtaaattacttggatactgatactgtcctatttcaggctaatgaagatgaagagttatttagttttcaagttcaagaatgggatccgattatccaatggttcaatgaaaagtatggagtgaatttaaagaaatcagttcaaatggatataccaacagctagtgaaaaggataagacgcaatttctcaaacatttaacgtctcataactttgctgcggtcaatggattcatgtatggagtagatacgc

SEQ ID NO: 215 - DNA, 695 bp, Diabrotica virgifera
  Annotation=Nudt18 protein
  SmartBlast Evalue=4E-58; Info=Nudt18 protein n=2 Tax=Culicini RepID=B0WKS7_CULQU
tctagctctatcaattagagggacgatgtcactggcccgcagctcaacctcgtccaatcttttaatccacctggcttgtagagattcttggttggcttcagaaggagtcttgatattacctcctataacttttccagtcaaaacaaatcttatccaattacctttcacagtttcaaccactaataatgttgtacattctatctttaggcctgtttcttctaagacttctctcttacatgcttctataatgttttctcctttctccatacgaccagctggtaaataccactttccagcacaagacttcttggcttcttgcatcatcaaaacttcattttgctcattaataacgatgcaaacaactatatagcagacggtttcaaagacaatcggtgtgaatttagggtcaacactaggctgaataccttgagactccagggcttcattttgctcttctaaagtaaaatcacatatttctgcctcttctccttccagtggaactccttttaggatatagtggagactttcttctacagaatctggcatctttgtattttatagtttaaacatggtatacttgaatgaatttgattttgaacataaactgattaatacttctttagaaaaagatacaccttaattcgaaatatgaaaacggtaagtcaacacattcctttctaaaactagtcccttcc

SEQ ID NO: 216 - DNA, 596 bp, Diabrotica virgifera
  Annotation=NADH:ubiquinone dehydrogenase, putative
  SmartBlast Evalue=1E-56; Info=NADH:ubiquinone dehydrogenase, putative n=2 Tax=Culicidae RepID=Q17M02_AEDAE
gcaaactaacataaaatacataaaatctatggtagttatttatccattttcacatttggatttaggaaaaataaatctattcattttgaagagctacacgaattaatatggccaaatactttggcattgataaattttttgtgtttttaaacacaatcaaagaagctggaggaataagagcttccttgtataaactttataggatggacaacttgagaccgggaacactggtcggtacagacaagtacggaaataaatattacgaaaatcctcattacttttatggcagaaatcgatggattgaatatgcaccttactatggtttggactatgatggaagccaggttcctgctgaatggtttggctggttacattacaaaactgaccttaccccagataaggatccatctagaccaaagtataaatggatggcagatcacacagaaaatttaagtggaactccagggcagtatatgccatattccactactagacccaaaattgaagcatggactcccccaggaaaatagaaaaatgttattttgtgtagtatattgtgaattttatgtataaataaattaaaataaatctaaaaa

SEQ ID NO: 217 - DNA, 719 bp, Diabrotica virgifera
  Annotation=Membrin
  SmartBlast Evalue=4E-49; Info=Membrin n=1 Tax=Aedes aegypti RepID=Q17AQ3_AEDAE
gttgacaaatcatctaaaacaaatcaaaacattttaacattcgtcttcaatgaaatgatatttaaatatggacacactatacaatcaaaccaacaagttaattcaacaaactcaagccaattttcaactactagaaggtagcggtaaaaatgctctggacattgaaggagatattcaacagaaactggatgtaataaatagcaattgtaacaaattggatttatacacattaaaagtacccttagatcagcgacaaaatgctaaaatgcggtgtgatcaattaaaatatgatagtaggcatttacaagctgctcttgctgctgctcagcaaaaaagacttcgcagagaagcagcagccaacgaaagagaacaacttttaaacagacgttttacagctaatcctgacatgactagcatcaatattgattatgcagtacaacatcaaggttctcttcaaaatgctcatcgaggtgtagatgaaatgcttgttacaggaaacaacactttagattcactgagaagtcaaagagcaaccttaaaaggagcccataaaagaatcatggatatggcgaatactcttggcttgagtaatcataccatgaaattgatagagaagagagtacacgaagataaattcatatttcttttaagtatttataactgttattgtgataattttagttgttatttatttgacctaatgtttttgaaaatatagt

SEQ ID NO: 218 - DNA, 614 bp, Diabrotica virgifera
  Annotation=Mitochondrial ribosomal protein L11
  SmartBlast Evalue=4E-53; Info=Mitochondrial ribosomal protein L11 n=1 Tax=Antheraea yamamai RepID=E3UUV5_ANTYA
aaaacatttaaaaataaaaagttcgaaatgtccaaagctgctgcaagattaaaatcactcaaaaaagtaaccgagaaaatacagcatggaaaaattagtaccaatatcccagcagggatggcaactgcaggacctccattggggccaatgttgggacagagaggaataaacattgcagctttctgtaaagattttaatgagaaaaccaaagatataaaggaaggtattccactacctacaagaataacagtgaatccagatagaagttatgaacttcaaattaatagacctcctgttgtatattttttaaaacaggcagcgggcattcaaagagctgctatggaaccaggtaaagaaattgctggcagagtcaccttaaaacaagtatacgaaatagctaaaatcaaacaaagtgatccttatctagaataagacctcttatagacatatgcaatatgatagttggaatagcaaaatcctgtggtattgaagttgtaagaaatttagatgccactgagtacggtgaatttcttaaagaaagaaagttgatagaagagcaacagaagaaggaattacaagaaaagaaagaagcaaaaatgctaagaactggttaa

SEQ ID NO: 219 - DNA, 444 bp, Diabrotica virgifera
  Annotation=Protein CLEC16A
  SmartBlast Evalue=7E-49; Info=Protein CLEC16A n=1 Tax= Camponotus floridanus RepID=E2AWT9_9HYME
gcatcgaaagacgttccggtacacctacaacaccttcttagtagaaaagatgctgcaaataataatcttttcgtgccaaccgtcttgtagagtacgactagtcaccctagaactcgccttaaagctgttcatacaactcacggtgtgtgatggcaagactgtattgtcagaatctcataggaatacaatagaaaccgcgagggtgcaaagtatggcgctgttaaggaatttttataagagtgaagaaatttttctcgatatgtttgaacatgaatactgtgatatgtcaaaaggttctttaaatgtcgaatggctgtgtatggatagtgcaattttattgcctccaactggtactcccatgacagggatagattttacaaaaagactgccgtgtggtgaggtagagcgagccagaagggctatacgagtctattttctcgtacg

SEQ ID NO: 220 - DNA, 632 bp, Diabrotica virgifera
  Annotation=15 kDa selenoprotein, putative
  SmartBlast Evalue=3E-50; Info=15 kDa selenoprotein, putative n= 1 Tax=Pediculus humanus corporis RepID=E0VEG0_PEDHC
gattggttaacttaagaatgttttgttaatttttttgagatttgagattattttctggatctacgacatggttgtgtaaaatatacgtactttttaactttaatactcacaattaagtattattaaaatgcgtttagttgccataggactgtttgtggtacttccgtcacttgtattgtcggagttttctacagaagattgttgggctcttggatttcacaaagcaaacttactgtgttcatcatgtgatcaattagtcaaatttcaattagatgaacttgtaaatcattgtaaagaatgctgtcacccagatgaagttaattcatcagaaaaagtttattataaagcggttctagaagtttgtacttgcaaatttggtgcatatccacaaatccaagcctttatcaaaagtgatagacctgataaattccccaacttacaaattaaatacctcagaggactcgatcccatcataaaactgtatgataaggatggacatctgcaagaaacagttgctattgaaaaatggaacacagactccgtagaagaatttttatctacacatttgataaaattagatgatgatgattatttaagaacaaatatggtgtaatatataatttttaatctgt

SEQ ID NO: 221 - DNA, 457 bp, Diabrotica virgifera
  Annotation=3110057O12Rik protein
  SmartBlast Evalue=8E-42; Info=3110057O12Rik protein n=1 Tax=Mus musculus RepID=B7ZNF5_MOUSE
tatggcgaaacccttactgaaagaaggtattggagctattatattagagaatcccttctatggtgttagaaaaccaaaggatcaaattagatctagtcttcaccatgtgtctgatatttttgttatgggtggctgccttatatttgagtgtatagttcttttaaactggtgtgaagaacgtggttttgggcctttaggagtaactgggatttctatgggaggtcacatggcttctttagcagcatcaaactggcccagacctttagtgctagtcccttgcttatcatggtccactgcatcatctgtatttacagagggtgtaatgagtgagtcaattgattgggaaatgctgcaagaccaatataaatccaacgaccttttgtgcaatagtctctctaagcaatgtaaaatcgttgataacccccttttttgtgtgaccttagccaaaatttgccag

SEQ ID NO: 222 - DNA, 843 bp, Diabrotica virgifera
  Annotation=Zgc:123096
  SmartBlast Evalue=0.000000009; Info=Zgc:123096 n=2 Tax=Danio rerio RepID=Q32LQ2_DANRE
acagaaccgtgacaggacagaacctaaaaaatctaaaattttagaatattttagtacttttgactttgttgatttatattaaaatgataaaatgaatattaacgttttgttcagaaatgtgcgaaattatagtaatttaaatttgtgtaaatttaatagtacaataacaaatcatttcttatgtaaacatgcaagtttttgtaccaagcagccttcatattttttaaataacaaatccttaaattcaggccttaatcaaagaagatggtattcagatgatccaagttctccttcaaacaaattacctccactactgccagactctcccatatttgtttggccttctttatttaaaactataagaaattttattcttgctacctttatcattaggccctatttagatcaagaatttaatcttccagattttgtaagtgcttctaaaaaagcagtggaggtagtatcacataaattgtctgaaggtgatattaaatcattagacggtctagtaacaaatgacattatcggtagtctacaaaaagcaatatctatgatgtccatgagtcaaagggagcagatagcaactagtgtagatgacatatatttttcatttccatatcaggttggtgttatatttaacgaagaagaaggcaaagaacaaaaacgattcgtcgaaataaccatggtttaccattctttgaaaggtttagctggaatgagatctagaggtgaagaacctcccttaaatatgggaatgctacctgaatatcaacaaaaaatttcgatttgcaactatagatttatcagagaatttacaaaaggggttgaaggagattggaccgt

SEQ ID NO: 223 - DNA, 566 bp, Diabrotica virgifera
  Annotation=Methyltransferase-like protein 11A
  SmartBlast Evalue=1E-52; Info=Methyltransferase-like protein 11A n=1 Tax=Camponotus floridanus RepID=E2AC78_9HYME
ctaaatattgatttatttattcacatttttagttttaagatgagttttgaatttttagacaatacagaagaaatattctataacaatgccgttaattattggtcagaaattccagcgacactggacggcatgctcggaggcttcggatacatctcccaaacagacatcaaaggctccaaaatgttgttaaagcagctctttaactccaaagatcctccgggaagagagtatgccctagattgtggagccgggatcggtagaatctctaaattcttgttgaccgagatgtttgaaaaggtagacttagtagaacaaaatgcagcttttctagaacaagcaaaaaagtatttaggaccaaagatagcgaaagtaccggagtgttattctgtaggcttgcaaaactttgagccggagcccaacaaatatgatgttatctggattcagtgggtcataggacatttaacgaataaagatctagtcaagtttttaaagtcttgcagcaagggtttaaagaaaaatggtgtgataattttaaaagaaaacataacctctacagatgatataga

SEQ ID NO: 224 - DNA, 444 bp, Diabrotica virgifera
  Annotation=Def8 protein, putative
  SmartBlast Evalue=4E-27; Info=Def8 protein, putative n=1 Tax= Brugia malayi RepID=A8PK75_BRUMA
gtcatcataagtgtctagcatctattgtcagggaatgtgctcatgtcatagctagtgaaaaaggatgttttgactatgatatatgccctgaattgggactctctgctcagagatacctctgcgctgaatgtaaatcgcctttaccagttaatagagattggtcagaagctagaagatgtgattacagtggactctacttttgcacagcctgccattggagtagttctgccattattccggccagggtcgtccacaactgggactttgatccacagccagtttcacaagcagctttgcagctactaagaataacttcccgtaggcctattatacatttaaacaaacttaaccccaagttgttcttattagtacacgaattagacctcgttagaagattgcgtcaaactttaatagggatgaagaagtatttaacagtatgtagaa

SEQ ID NO: 225 - DNA, 626 bp, Diabrotica virgifera
  Annotation=Zinc finger CCCH domain-containing protein 11A
  SmartBlast Evalue=8E-39; Info=Zinc finger CCCH domain- containing protein 11A n=1 Tax=Harpegnathos saltator RepID= E2BE92_9HYME
gcattctcgaaaatatcctctctctcatcatattagcttgaccgtcatattggaaagaatcatctgaatatgaatagtaagcagctgattctgcttgtatcttctctagcctgatctcttccaaagatttcactgtacaaatgcgttccttgtgttttgcgggcgagtatgtgggcatagactcattatctgactcttcttcaaaatttacgactaggtcctctcctacggttacgtttcgttcactattgtttaaattgcctacagactcggctgtagataaatatgatctattaacagcatctacgggtcttggattctgatgtaaaaatgagcaatgtccttttaagcaacctcctggttgactctcccaataacacggtatagcttttctgttttttcttagttccatatgtcggaaattacattggatgttaaaacacttgccttccttccaaaaactgcacatggtttcacaacctaaggcagatggttcatggcgaaatatacaactatctcccttagaacatgtcgaataataataaaaataacagtcgtttatttttttgggcgaatctagatccgtcattctttttaaaaaaattgtccaggccaaaagagttaac

SEQ ID NO: 226 - DNA, 1166 bp, Diabrotica virgifera
  Annotation=Upstream activation factor subunit UAF30
  SmartBlast Evalue=7E-48; Info=Upstream activation factor subunit UAF30 n=2 Tax=Formicidae RepID=E2B426_9HYME
tttttccatagttttatttatttaataaaaatctgcacatactcatacagttacagaacatttacaggtgcacagttacacaaaaccattacggatattctgatacatttttttattataaaaaaagaaactcgtgtttaataaaacttaaaactaaatcagtcctaatcgggcttataataaaaatatttatttgaaattctctatttaacatttatatttttaacaccaactagcacaataatacaaacaccaaactactgaaaaaaacgtactcaaacttgagtactccggaaaggataaatgggcgctagttggcgaatacgcagaaaatttagctgatgaaatgattcttcaaatacttcatcataccgaacgtgcggaaacgtttcgttccgatgaccttcatcaatgcatcatcacagatggcgtactgtttgtttttgggatcgtacaaatctttttctttgattatagaccatactttcttgacgacttcatgccgagccatcgtgtcctgaccgaccaacgctgccaattctggagataagttcattacttttgtgtaaccgctacctcctttcttgcctccgccgccacccttctttcccttctttttgccccagtcttcatctgagtcagattcggaacccttcttcttcttggggggaagtttgcgtgtcttgactggttttgcctttttgggtgaatattcttcttcagaatcgccatcgctctgttcgctggcagattcatcttctgatgttttctttgccttctttgctgctggcttcttaccagtggaggcgcgttttttctttttctcatcttcagaaggttcctcttcctcctcttcttcttcctcctcctcctcttcctcagattctgccttcttcttaccgcccttcttcttgtcctgctttgaactgacgaattccattaccaaatcgtcaatttctttctttctagattgtagatttgtttctagtttctcctctagctcctgtctcaccttcttggcagaagtggatgaaaggtcggcatcttttaagatggcggcaatttctttgcgaagatcttcttttgagatgtctgccatgttgctagagagagaacagtaaacgtaataaaagatggagaaacaagttcaatctacgaatgtggct

SEQ ID NO: 227 - DNA, 751 bp, Diabrotica virgifera
  Annotation=Phosphatidylserine decarboxylase
  SmartBlast Evalue=1E-36; Info=Phosphatidylserine decarboxylase n=1 Tax=Aedes aegypti RepID=Q16TJ5_AEDAE
tgtattctcaccaaaaaagtcttttagtgaatatgttactccttttacctgttcaacttgttcagtatcaacagtcccgaaatggaggaccgtcccgtcacatggcgatacaagacagctactctcgtcgacttgtcttacaccacttttaagagatctggcaaaaaaatctgccagactggggtaagacgttaaatcctcgttttcagcttctgcgatgttaacaccgaatgcgttggagtacattttgtaaacgggaggcctcagtacttcgggtagtgttacatcggctatatacccccaacatctagatactgttcttaaaggaagtaaacaataacagttgatctcccatttacttgcaattccttccttttgtcttttccttaatgctctccactgcataacggctactaagcatattccgactggtaaaaatcgagtaattatcatttgccattctgaacctctcgaagatttttgctttgttgatacatttctgttgacagctgatgtaaggaagaaccttgaacttagcgtcgtcgtcttctgtggaacaagcatgaagctcctaagcggtatcaggcggtaaaacatgcgacttttttgaattaagatagacattttaggataactaacgggttaacttcacactaacataaactgtgttcaattataattttcctttaattaatgacaacgcgaacaaaggaacaaagaatttaaaattcaaaaaaggatgtagaccgca

SEQ ID NO: 228 - DNA, 548 bp, Diabrotica virgifera
  Annotation=N-acetyltransferase 9-like protein
  SmartBlast Evalue=2E-45; Info=N-acetyltransferase 9-like protein n=1 Tax=Harpegnathos saltator RepID=E2C8N5_9HYME
agacaccactatacaatgccaaagagtaatattaataccttatagaaaagaacacgttttaaaatatcatttgtggatgaaatcagaaaacctacaacatttaactggatcggaacctttaactttagaagaggaatatgaaatgcaaaagtcgtggcttatggatgaaaacaaattaacattcatagttcttgacaaacagaaatatgaagaaacacaaaacgaaataaattcaatgattggggacacaaatttattttttgccaatgcagatgacagaatatgtgcggaggctgagataatgatagcggaagaatgggccagaggtagaaagtgtggatgggaagccatgctactcatgtttatgtatggcatacaatatttaggagtgaagcaatatattgtaaaaattttgtatgacaatgatgttagtataaagatgttccaggaaatgggctttgtagaggtcagtaggagtgaagtttttaaagaggttacttatagcaaactagtggacgagctgtggataacatggatgaaaaataatt

SEQ ID NO: 229 - DNA, 949 bp, Diabrotica virgifera
  Annotation=Alkylated DNA repair protein alkB-like protein 1
  SmartBlast Evalue=1E-75; Info=Alkylated DNA repair protein alkB- like protein 1 n=1 Tax=Camponotus floridanus RepID=E2ATD6_9HYME
tgtttgtattttattaataatgtaagtgattatttaactaaatatttaaacagtttagtcaatacggctgctgactttttacacatttttccgtaatgtatactttaaaccacaaaaaatgtttaaacaatcatttaaatattataagtcgaaaaatccaccacccaatttggatgatgttctcaatttaaataagtctgaggaattattagcaaaatccctaataaagtatgttgacgtacattttaatacgaaggaagggtctcattatggtttaagaaaacccagtgaatgggaagcatatgaaatcgtatccaaaagaggcttaattttcatcaaaaatccatttctgccaagtggtcaaaggtattggattaaaaaaaagtcttcaagaatactccaaaaaaccaaataaactaaacattgacccctttaataccttgacaaataatgcagactggtgggatgttggccaagcagataagaaaattttgatgagtctgcgatgggctactcttggttatcatcacaattgggattccaaaatatattcagaacaaaacaaatcagaatttcctatagatttaaaagatatgactgaatatgtatccagtaagctaggatttttaaacttcactgcagaagcagcaattgttaattattatcatcttgattcaacactttctggtcatactgatcattccgagcaaaatttagaagctccattgttttcctttagttttggacaaagcgcaatatttttacttggaggggaaaccttagacgagaaacccactgccatatttttgcatagtggagacattgttataatgagcaaagattcaaggttatgctatcatggagttccaaaaataatgaaaactaacaatgaaacatggaatgaggatagtgagtatgtcttagctaatgaagactctttaggcactaa

SEQ ID NO: 230 - DNA, 599 bp, Diabrotica virgifera
  Annotation=TBC1 domain family
  SmartBlast Evalue=4E-39; Info=TBC1 domain family n=1 Tax=Culex quinquefasciatus RepID=B0WCS2_CULQU
ctgggcgcaggtttggcttcttgacttgtaactgttctgatttgcgtgataataggtacattttgtttaatctcccagtcgtcggagctttcttcgaaaggtttcagatccactcttaaggacaaacaaggttcactgttgctagccacagaggcattgtgagcttttaaaaaggcagcatccaaatcccaatcagaaagtatgggcatgtatgtttcgtatccattcacatcatatattctgaaacaaacagtgaagtcccccttgagatcaaaggcttttgccaaaatgctttgcagcacttcaaaagaagttatttggggatctacactgaacttcctcatttctggtggctgatttctttcacatttcttaacttttacccttacagcttctcggctgtatccaaatactcctgacatgttaactgataattttaatgaaatattaaatagatggttcaattacatacagaaaggaatatacattttttaatatattaaacatttcactatgttcaatatatcacaccatactccaagacttattatcaactgaaaaatcaaagcattaaaatttcaatttgttcctaccattct

SEQ ID NO: 231 - DNA, 697 bp, Diabrotica virgifera
  Annotation=CG4618
  SmartBlast Evalue=8E-46; Info=CG4618 n=11 Tax=Drosophila RepID= Q9VRJ5_DROME
ataacaactggaatttataatttattgtacctaattatcatcctataaaaatttacaacgaatatttgaaggtgttttcatcgaaaaaacaatataaacattttaaattttggtagtaaattgttcaataaatattataaatcaacatgttcaatttttggtcaaaacctgatccaaaagatgaacagagagaagtggataggtcattaagaaaagtaggaagggatattgaaagagatcgcagacaattagaaagagatgagcaaaaattggaactagaaattaagaaattagcaaagagtggagatgcggcaggttgtagaatattagcaaaacagttagtgcagcttcgtaaacagaaacaacgaacatatacagctggcagtaaagtacaaggaatagcgttccagaacaaagctatgggagctaatgttaaattggcaaatgcgatgggcacagcaggaaagacgatgtcagatatgaacaaaattatgaatcctgaagaattatcatctactcttaatgcattctctagagaaaatatgaaaatggagatgacagatgaaatggtgaatgatactttagatgacatgctaacagaatcaggagatgaagaggaaagtgataacattgttacccaagtattagatgagattggcattgaagtcagtggaaagatggcaggggcaccgttacc

SEQ ID NO: 232 - DNA, 492 bp, Diabrotica virgifera
  Annotation=Exocyst complex component, putative
  SmartBlast Evalue=3E-31; Info=Exocyst complex component, putative n=1 Tax=Pediculus humanus corporis RepID=E0VIX9_PEDHC
gggagcgtgttacagaggtcgttaaccatgttaagaaatcatcaaaaatctgtcagcggtggaagtgtacatggtacaacaagttcgcccatgctaaaacccaaattcccaaataggcacgaagcatcaagaaaaccatccaccagacgaataggccaagttttcgaaagaaaagccaacaagatgcttctcaaagcttctcatactttggagcaatctactgggctctctttaggaactagaagggcatcacatttagatacatcatatattggggaagaattagataatgaacaagaaatggaaaattatctgatatcggtaatagcgttacacagattaatgcaatttgaacaaattttgatgaaagatatcataactcccgcacatcaaccaagggtatttgaacttatcgttagggaagctatggatactattgttcaagatggcgagaatatcgtatctcgagcaaaaaaatgtatagccaggcat

SEQ ID NO: 233 - DNA, 798 bp, Diabrotica virgifera
  Annotation=Mediator of RNA polymerase II transcription subunit 6
  SmartBlast Evalue=5E-82; Info=Mediator of RNA polymerase II transcription subunit 6 n=1 Tax=Pediculus humanus corporis RepID=E0VYJ6_PEDHC
ttcttctctggaggtggtttgattttcccctgtttcggctccttttttatctccttattctcaggagctccattgtcaggttcttgtttaatttgtggagctggtggtattttaggctgaggaggagcaggcaaggggaattttcttattaattctcctagtaacatatcaaccctttgtctttgaaacaacgaactaggttcttcccttggtttttcatctttttttaccttttcagctgctcgctgagatttgaaatcccaagaatagcccttactgggatgatacttggcaaaacctgaagattcctcaaaggatgattgcaaatagtgtacggctgatagcagtcgggagttcaaaacacttgctagatcaggagcctggtaaacaataccagcaataatatagtaatctgctaaagcaatagcctgctgaggactttgcctgtgctgctttcgaattacatacaaaatcggttcttgaacgtgtagaagaacatactctacaccagtcatattttgcaattggtcagtactgagccgctgcattttgacaatttcattgttacaagttctatcaaaaaaagggtttgatccttgggaaaagtattccattatattggaagtatttagaatgggaatccaggccgaatcatgccatgagagactaagagggttgtcggggatagccgggttcgttattcctagtctgccagccatcatttttaaataattagctactatgcaatgttttaaatcagataaatataaaccagatatacacaaattagttaaagtt

SEQ ID NO: 234 - DNA, 894 bp, Diabrotica virgifera
  Annotation=Thioredoxin domain-containing protein 15
  SmartBlast Evalue=4E-34; Info=Thioredoxin domain-containing protein 15 n=1 Tax=Camponotus floridanus RepID=E2ABW7_9HYME
gaaaaaagaaaacaatttggttaaactttaaattaaaaaaagcttatgaactcttcaaattttttagatagttatgaatggattaaaaatatttctttcactttttcttttaataggtgttttgattggtaaaatacataatgaacaaattctggacaatttagaaactacagagcagccccaagctattgacgaaacactaaacaatgtcgaagctactactgatatacccactacagataataaagaggttagtgaagtaccagaacctgtaacagacaatggggatgtcagtgaagaatcacttgcagtaaaagaagaacttactaacgaatttcctgtccaaaattctacagcaaattcaacagaagtggttaataaaacacaaagatttgtacaatgtttgccagctatgggagacatcgaagtacagctaacgaacgacacagagctcataaaactgttacagcctgatcccaaagtaaccagcagagatgctcctgcgatgtgtgttgccgtattattctattcaaagtattgcccgttttctacattagcagcaccacactttaacgccctacccagagtatttccagacataaaaatggtggctataaacgctatgatgtatcatctctttaacactcagaatggtattgtaggtgtaccatcactgctattgttccataacggcagatccgttgggaaattcaaccattcagaatatactcttgaaaagttttcgcagttcattttgaaacatacaggtatttccccagtagagagtgtagctgtaacgtcatccgatttcgcaggaccagttgttaatgttcctgccagggactatgatttgtttttgatactttcttggttgtttatcttgttgtgtggggg

SEQ ID NO: 235 - DNA, 803 bp, Diabrotica virgifera
  Annotation=Gualynate kinase-1 (Fragment)
  SmartBlast Evalue=2E-67; Info=Gualynate kinase-1 (Fragment) n= 13 Tax=Gryllus RepID=B3GBZ1_GRYPE
cgacaatttgaatcgtgtatcgtgtatgaactttgttttgaaggatatttgagcgataagtcagtccggtgcccccccacccagatgtcgcgtttgttgcttacattcgttatggttaaatgaagcattctcaaggatgacgacagttatccggccactgctagtatgcggcccttctggcgtcggaaagagcacacttgtcaagagaatcctggaggaattcccagacagatttggattctccgttagccacacgacgcgaaaacccagaccgggcgaacaagatggcgtccactatcatttcaccgatgtggaagtcatgaaggaagccattgccgaaggcaagttcctagaaaatgcagtattcagcgaaaatatgtacggcaccagtaagaaggcagtacaggatatcgccaaccaaggtaaagtatgtatattggacatcgatgtccaaggcgtaaagcaagtcaagaccaccgaccttaacccatggagtattttcgtcaggcctcccacgttggacgtccttaaggagagactgttacaaaggaaaacagagacagaacagagcttgcagaagagactgagcttcgccgagggtgagatggagtacggatctaatcccggtaacttcgatctcgtcatcgtcaacgacgacttcgaagctgcttacaaagagttcagagattttatcgttaacaatgtattagtattcaaaggcaatatgtaaacgcttgtattaatcagtatcattcctttttttatatataataattattattaaatgttttggttacgctgct

SEQ ID NO: 236 - DNA, 494 bp, Diabrotica virgifera
  Annotation=KTI12 protein, putative
  SmartBlast Evalue=2E-46; Info=KTI12 protein, putative n=1 Tax= Aedes aegypti RepID=Q16WB1_AEDAE
gtaatttttagtttataaattagaataagaaaaaaatgcctttaatagtaattacaggtgttccaagcagtggtaaaactacaagaagtcaagaattacgaaaattctttgaagaacaaggtaaagaagttcatattattagtgaattagaccatattgtgaatgctggttttgaaaagaactccttctatgacgataaagacaaagaaaagcatattagaggacttttgaaatctgaggtattaaaattagtgtctgctaataatattgtaattttggatgccttgaattacataaaaggatatagatatgaacttttctgcggaaccaaagcgaataaatgtactcagtgtacagttcacactgaaataaatcgagaagaggcttggcagtttaatgaaaaccgaacaaatgaagctgaaaaatacaatagagaaacctttgatgcccttgttatgaggtacgaagatcctaatggtaacaacagatgggac

SEQ ID NO: 237 - DNA, 872 bp, Diabrotica virgifera
  Annotation=Lymphoid-retiricted membrane protein, jaw1, putative (Fragment)
  SmartBlast Evalue=1E-15; Info=Lymphoid-retiricted membrane protein, jaw1, putative (Fragment) n=1 Tax=Ixodes scapularis RepID=B7PU49_IXOSC
gtgccaccggacagtagtagttgtggtcgttttccgagccacgctttcttatcattgtaagttaaactcgcgcgaaaatatgaatgaagtggacaagccatcggttaacaattttccgaccgggcggtcgaagcttgaaccggcggtcaatcacaatcacaatgacaggaaaagtttagtgatcaggaaggaatcccaagtgtcgttgtccagtgtttcggattgtctttcagatgaaagtgaggactatggagtgcagatcgagaggaaaacgtcactgcaggaatttgctaagaaagttgatgacaagagaattttgtacaaacaacggggacgttctatgtcagatggagagacgcgaaggataaaaaatgatgactcaacttttgaagtattccctagtctgccaaattctgtgttagagaaattaggacttcgtggagatggaccacgggagcatatgaacgaagaagaactagaacaaaaattcacgagccttgccttagccttcacgatagatgctactacaataaaggatagatgcgagaggcaaagacgatctagggaccaaactgaaaacaatcttactaaggaaatcgagaagcttagagaaaaactgactttcatgcagccactctgcaaagattatgaaacagccgaaatattttcaacaattatgactcagttagatataataatgaatgctgcgtcattagcttcgatgtcggccgaacggtttggatcagttcaacacgaagaacgtttaacggaatcagtaggtcttatggtcagccatgtacaaatgttgaaacaacagagagacgctacgaggagacagttgcaatataccaaaagagttctgcaaaattcag

SEQ ID NO: 238 - DNA, 635 bp, Diabrotica virgifera
  Annotation=Methyltransferase-like protein 9
  SmartBlast Evalue=3E-40; Info=Methyltransferase-like protein 9 n=10 Tax=Theria RepID=METL9_HUMAN
ttttcatgctctaagtcgcgtcgtattttttgcagttcgtcttgtgtttggtttcataaagtgcctgtttttggaataagctaaagaaatgaagagatacaaaatgaggattgagtggtaccagtgtcacctagactctttgccagcgttaatctcaacgaaatttgttcagctgggtccagatcaagaaacaataaactttttagatcagtctgagaaaaaatctgactggctttttacgcaaatatggcattcagtggttaaacttttcctgggtgtatttatgacacaaacttcaataaatgggtggcttcaaagaggttctatgtttgtggtgtctcaacctcaggtgagaaaactgttaggagtagatgaagactggaaatgcaaaagccttttagatataggagcaggagatggaaaagttacggaccaaatagcgccaatatttcataaggtttatgcaacagaagtttcaagcaccatgagaacattacttcaaaagaaaggctatgaactactggaaattaatgactggtttgtggacaaaaaatttgattttatatcatgtctcaatgtgatcgatcgctgtgatactcccctaaaattattacatcaaatgagagatgcattaa

SEQ ID NO: 239 - DNA, 1662 bp, Diabrotica virgifera
  Annotation=Novel protein
ttgcagaagaaaaggcagaatatcaaaaattacaagaggatatggttctgcttcaatcagggaaggtatcagaggaacaattagataagtggtgtcaggaaatagaagatgaagagaaccaaaaagaacaagaatccctcacacactccagatggttgaaagagagggagctacgtaaacaggaaattgaaaaagtctggagaccttcaaaaaacaataatgggacagaaacgtaaaagctcagaccggctagataatctgatcgaacaagaacatatggatgagcttatgcttcaacagcaaccacagctcaatcaacaacaacaacatcatcagatatattcacaaccttcagagacaatgaaacctgccctttctcctttactgacaagtttattaaaatctccttcacaagttccaagcactcctattctacatacagctattaccaatagacctattcctaatactagtaccaatcctatgatagcaagtttattaaattcatcacctaccgtaacagtatctcctggtctacaacaactcgttagttcagctattggccaagaaacgccagaattggttggacaaattcagcaccatcagccacaacagcaccaacctattacaaacgacatcttggatgatccaagcttgcctaacatcaaaattgacgatttggcgaacagtatattggtccaggatggtcccctgccagaaataaagaaagaagaagtcgatgatattatatcggagatcatagagaatgcgaatgatattgtaactgatcccgagcaacatttagaattggacgttaacggagatattaatattaatttggagtttgacgatgaagatgaccttcaagacattgtagagcccaagattgagccaaaagaagaaaagaaagtggaagaaaaatttgttactcccgccccggttgtggatccttttgaattccaggaggatcctgtcatccaaccttcggtgaaagtttccaacattaacaaacaggaccacaaaccgtacgttccccagtatcagcaacaggcttcttatttggaacaagcaagcaccaccggcaaagagatcgaactgcagcagaatagaagtcagtatattcctaatgtcgaagagccgaaagaagaaccgaaaaatacttcgcccgttatatcacagcttcaagaaactgaagaacctcaaccggaaccacaagaggaacacgttgtaaaaactgaaccctccgtggttccgggctccgtcgaaatagtagaagtcgtggtaaccgacgacgatgagctagacaaagaagcttccaaatcggaagtgatcagttcagaaaaatcgaacgattccgaagacgttaagtcgataagaacggaaatcgaagaaaaaatcaaaacagaaaacgaagaaagcagtcccacagaaagcaaagatacgacgtcgattgctacctacgaagaatcttccgagacctcagattcggtggccgaagttaaaaaagaagaatctggaaaagatgtcgaaattaagactgagttcggggatgaattgttcgatgagatgaatatagaagttaaatttgataaaaatgcaaagaagagggattattccaggacaaagaaaaaggatgagaaaggttttaatatgctccttggt

SEQ ID NO: 240 - DNA, 682 bp, Diabrotica virgifera
  Annotation=Zinc finger FYVE domain-containing protein 19
  SmartBlast Evalue=9E-29; Info=Zinc finger FYVE domain- containing protein 19 n=1 Tax=Harpegnathos saltator RepID= E2BUL5_9HYME
gttaacaataaatgtttttattatagtctaccacaaaatataggtctttaaaattactaataaacaaaaatgtcgtgcaatcagtgtaatacgaaattcaactttttccacaaagaaatgggttgtggctgctgtggtttggccttttgtagtaaatgtatcaagcaaaaatccaaagttccttcaaaaggcgacgaagaattaaatgtttgtaagaagtgttatctgagaataaactcaggagcaactcaaactgtgaacaggccgccacctgatgtatttattaagagactagaaactttagaaaacccagctgcacctcctataactgtatataaaaaagcagatccaaaaatggaatcattacgtagtggcctctccgctgctgatcagaagctgttggaaagattggagaaactgaaggatgatggaaaaggaccgccgccaaccgaatctgagattagggagagattaaggaatcttaaaggagaaaatgagtatgtagagggacctagtaaagcagtttacacagtggacacacgaacagaccaagaaaaaactgattctctgctggagcaatttatgaatgagcgagatatcgaactgtctcaccaaaaccttgatggcatagaagccagagtggcagccttaagggaacaaggggtaaggccaaacgagggac

SEQ ID NO: 241 - DNA, 870 bp, Diabrotica virgifera
  Annotation=Novel protein
taactcgcaataatagaatttaaggggtcggcaccctgaacaacttgctacataatttttcaaaaatgaacagctacgtagtgctcgttgttatgtttttggccgtggcctttgctgcggaggaagaagccaaggctgatggcccgaaaacttacaggaggttgatccctgctgacgttcttagggatttccctggaatgtgcttcgcctccaccaaatgcgcaacagttgaaccaggtaaatcatgggaccttacaccattctgcggtcgctcaacctgcgtcgtttctgaagacaaaccaccacgtctcttggaattggtagaagactgtggaccacttcctttggctaaccccaaatgcaaacttgacgaagaaaaaaccaacaaaactgcagccttcccttattgctgtccacaatttacttgtgaagaaggagccaaattagaatacccagaaattccaaccgttgcaccagtcccagaagacgctgcagcaactacaaccaaagcttaatttctacaatcaactaaattttccttcttattttttctcccttctatactcaaaaactgatttaaaaaagctcacagaaaatatttttagcagcaggtagtaaaaatttggtgtcgaaagtacctatacagtttatgttctattgcgcaggcgccaaaaagctgttagaaacaatatgaggtaacctaaataaaaaaaattgttaaatatttaaattattgcaaaatatgcattttcaaagtttattcattgtttcactaatttataaacacgctttgtaatacttgcctccattttatttttcattgtttacgttacttttgtatttttgtaaacgaaataaagtaaattaaac

SEQ ID NO: 242 - DNA, 524 bp, Diabrotica virgifera
  Annotation=Protein FAM91A1
  SmartBlast Evalue=2E-26; Info=Protein FAM91A1 n=19 Tax=Theria RepID=F91A1_HUMAN
gttctcggtttttatccgggacaatttggagaatcctgatccagcagttcggttattcctacccagtctaacttgcttctccctattcggacaaccaaaatcgagaacgccgatattggcgaaggtcagatatccacaattgtggtccagatcgaccacttcctgcaaatacttgaccgccttgtgttgcctgaacgccaaatccgtgggtcgctctttgattttcttctcgttcgatttgatgggggtcagaggctggaacgggaaggatattatgtgtgtttgggccggttgatgcactccgtaggcttggatcaggacagggctgaattggagagtggcgttgacgtagaggatgttggctatggggatgacggctggctcgtgaagccacgagtggatcagtagacgggaaaagccgagaaacatgcgtggtagttgatttagagttgttccctttgtaagaagtaaagacggtggtccgtatccagtgagatggtataaaaataatttgaaccataagg

SEQ ID NO: 243 - DNA, 458 bp, Diabrotica virgifera
  Annotation=Protein enabled
  SmartBlast Evalue=4E-48; Info=Protein enabled n=1 Tax= Harpegnathos saltator RepID=E2C537_9HYME
tcggcggtctttcgatcggtcccacggaaatggagagtcttaaaaaatgagatagtcaaagaagtcagaaaagaaatcgcgaaaatgaaacaagacatattagatgcgagcaatccatcgctagtgcccgagcaagtgtaatggtatacgacgatgttaacaaaaagtggattccatcgggcacgtcgtcgggtctttcaaaagttcacatctaccaacatacggtgcaccagacgtttcgagtggttggaaggaaacttcacgaccatgaggtcgtcataaactgtgccattctaaaaggactgaaatacaaccaagccacatcgacgtttcatcagtggcgagacaataagcaggtttacggattaaattttagctctaaagaagacgcagattgtttcgccagagccatgttccattcattagaagtacttagcaacatagttaggcaacccgca

SEQ ID NO: 244 - DNA, 2872 bp, Diabrotica virgifera
  Annotation=Cleavage and polyadenylation specificity factor subunit 6
  SmartBlast Evalue=2E-51; Info=Cleavage and polyadenylation specificity factor subunit 6 n=2 Tax=Aculeata RepID=E2AFK4_9HYME
gtatttagctctgaagattgagtttttacttccgtgaaaaatttttacgagtttttattgtcatcgttataatattttcgacaactgcagttctgtatatagtcggtttgaaaatcttaaagaaaataatgagggtatgaatttaaacgtgctccaatattagcgcttagcgtgtatttgccggtgtattgtgttcaacgtcaccatcaaccatgatgcaagcaaacaatcgagtcccacctataaagttggaaaacgatatagatctttacgccgatgatatcgaggatttcgcacaagatgactttggtggtgaaaatgttgatctatatgacgatgtaatatccgctcctcctggaaataatgacaacccaggtgattcaaatcatcatgctcctcctggtgctggtgaagatggtggaggtaattttgttgggtcaggaggagcacccaataatataaattcttctggaagaagacatcagctgtatgttggaaatctgacttggtggacaactgatcaagatatagaaaatgcagtgcatgatataggggtaaccgacttccatgaagttaagttttttgaacacagagcaaatggtcaatccaagggattctgtgtcatatctttgggatctgagggaagcatgagactctgcctggaactcctatctaaaaaagagatcaatggccaaaatccccttgttacccttcccacaaaacaagctcttagtaactttgaaagtcagtctaaaacacgcccttctcctactaataattctaactcacgtcctccccatcctaataataatgttcattcaggtcctatgcagaattatggaggtagaatgcctatgaacccttccatgcgtcccatgcccccaggtatgcaaggtgctccaagaatgcagggtccacctggatttaatggaccaccaaacatgaatcagcaaccccccaggttccaaggtaatccacaatggaatggacctagacctaatggtcctgggcccaatatgggaatgagacccatggggccacctcatggacaacaagggcccccaagaccaccaatgcagggaccaccgcagcaaggtcctccaagaggaatgccgccacaaggtccaccgcagatgcgtccagaatggaatcgaccaccaatgcaacaagggtaccctcaaggcccgccgcatatgcaaggacctaacatgggtccaagaggtccaccccaaatgggaccacccggggcgcctcaacagcaaggaccagctccgcacgtaaatccagcattctttcaacaaggaggaggaccaccgcccccaatgcaacacatgcctggaccagggcccgtcatgcctcctcaaggacccccgcaaggtccaccacacggacctgttggacctccacacggcccaccattgggtccagcgaatgttccgcctcatggaccacctcacggatatggtccacctgcagcgatgccacagccgccatacggtggcccacctccagaccaccgcgctgagattcctcagttaacagagcaagagtttgaggatataatgtcccggaatagaacagtttccagttcggcgattgggcgggccgtatccgacgccgcagctggagaatttgcaagcgccattgagactttggttactgctatttcactcatcaaacaatccaaagtggctaacgacgatcgttgcaagatccttataagttcgctgcaagatactttgcgtggtgtcgaagacaaaagctacagctccagccgcagagaccggtcaagatccagggacagatcacatagaagaactagaagagaacgatcctcgtcacggtacagagacagaagcagagagagggagcgtgaacgcgatagagatcgtgatcgtgaacgtgacagatattatgatagatacagcgaaagagaaagagaccgagatcgttcaagaagcagagaaagaacagaaagggatagagaacgagattatagagaccgggaacccgaagagacagataaagaaaaatctaaagtatccagagtctcaagatcaagaaacaaatctccggaacctgtcgaacctagcagcgaggtaccgaaatcatcccgctattatgaggataggtatcgggaacgagagagagaaggtcgacgagagagcgatcgcgaaagagaaagagatagaagaggggaagacagccataggtctcgacactagcatatagttagcggttcacagaaacaacaacaaacaagttatagttggagttcaaacaaagattatcgtgtttaatttagagataggttataatatgtgatgttactttacataaatttaaacaggttccgaatgtgtaagttaaaagagcaaaggaaacattcactaactcatattttgctacttgtttcattttgcaatggaacttctggctatcttaaatgtattcataaaaaggataaaaaacatttacctgtttattgttgtattaagtaaatcattgactataatattgcgataaatgttagatattttacttcatggggttatacttttgatgtaaaagtttcacatatttagctttaagcaaacgtgacttactatgaatataataaattatgtaagaacaaaattaagtaatgaatataccacataattcttcaactaatgagttactatgtacagtatattcttcttactatttcttcagttttctcctggagtagcaaaacttgtttttgtaaaatgaatttattgtttaggctgtgctatattaacactgggtcgtctattaatctgttaaaaaacagtttttgagagaattctgttctttataaaaaattacaggagggtgatgaaaggcttta

SEQ ID NO: 245 - DNA, 537 bp, Diabrotica virgifera
  Annotation=Small GTPase, putative
  SmartBlast Evalue=5E-47; Info=Small GTPase, putative n=2 Tax= Aedes aegypti RepID=Q16MT2_AEDAE
cgtaaaacaagaagtttattgtttatcaaaatatttattaccgaatttcaataaaatgtcggtcatagacagggtgagaattctagtattaggcgattccggagttggcaaaacatctttcgttcatttggcagctcataatgaaccccttcgatcacctagttggactgtaggctgttcagtagatgtgaagttacatgaatataaagagggcatgaaggaccaaaagacgttttttgttgaattttgggacataggtggtagccattcacacagaaacgcacggcctgtattttacaatccttttcatggtgccatactagtgcatgatttaacaaaccgaaaatctgaaaagaatttacacaaatgggttagagaaattagtgtaaataggagagaaagaaaagattctaatagtgcaacaaatcctgttttgccagggttattaggcgacgatttcgaccaagagagttttataggaaatatgtcaataccttatattgtaataggaaccaaattggatcagcttgatgatcg

SEQ ID NO: 246 - DNA, 732 bp, Diabrotica virgifera
  Annotation=Multiprotein Bridging Factor 1
  SmartBlast Evalue=1E-50; Info=Multiprotein Bridging Factor 1 n= 8 Tax=Sophophora RepID=Q9XZ03_DROME
tcaatattgcattagattacttcattttatagatatatttttaatattaaataaaaaccatggctgattgggatacagtgactgttttaaagaaaagagcacctaaagcttccacaatgaaaagtgagcaagcaataaatgcagctcgtcgccaaggagtagctgtcgacacgcagttaaagtggggtgccggtagtaataaacaacatgtagcaacaaaaaatactgctaaattggatagggaaacagaagaactgaaacatgaatccatatcactggatgtaggaaagttgatccaacagggtcgtcagtcaaaggggctcagccaaaaagaccttgccacaaaaattaacgaaaaaccacaagttataacagactatgaagccggccgaggtataccaaacaatgcaattattggtaaaattgaacgtatcatcggaattaaactcagaggaaaagatcgtggactaccagtagtactgcccccaggaaacaaaaagtaggtgaggtcctgggggaataacataacaattttgattaaggtttttctacctaaataatagttcacttctaggattcctgcatttactgtaagaacccttgcaatcttacacccatatgtagggttaatattaaatgttaagttgttttttagaaataaaatctctgtgtaccgctactgtaataaaattaatattaactgtttaaataaaaaaataaattggtggtttg

SEQ ID NO: 247 - DNA, 1192 bp, Diabrotica virgifera
  misc_feature (18)..(18): n is a, c, g, or t
  Annotation=Myb-like protein; Pfam: PF13921
  SmartBlast Evalue=5E-22; Info=Novel protein n=4 Tax=Eutheria RepID=A2CF81_MOUSE
agttctaatactctgcangtctggatgaattttgtcattgcaaacatgtatttcagcagtcactctacatcaagttatgaatagttataaattagcagaggaaataatatatacacatcaataataccaaacattttagtaactttatatcaatatcagaatcaaaaataaagttattattaattataagtacatattaaaattccttaaatattttttattttactggaattttcattattaaaaacacatacaaaggtattttcaaacaactacttattttctaactgtatattattattacgttaaatgttgtaaataatttgtggacattattgatatgtatagttggattattgttaatataacaaccgtaaactagcagtgtatccataaaaatcatgaatacctgaatcaaaaccacttttcagacattattagtggcacataatatctatatgccttataattttaatatttaaaaaaaattttacaattttgtttagtagttcattgaaaatgaaaacttacgatgaaacttcatcatttcccccatcaaactctagttttacatcttcatggagaccttcaacatcaacttcagattctgcagcatttaacatatttaaagtgacttcagattttatcataggttgctgttgaagctggactggcggtactgcctgattaacctgcctcactggtaatcctgcatcctcaaaggctttcttctttaatgccgtcctaatttgggatactgtccgcctttttatgtgatcactaatttggtttaatccatctgaaaattgtttgacaacttggcgtagcatctcaatttcttcatcagtccattttcctgtaggagattctgcattaggatgcaattgcattgttagatctcctaatctattaaaagcttgtcctgcggcggtgaatatttcaccaaccttgctggctgaactcataactattttattaaaaataataaatactcctaaaataattcaaaatcaaaacatttccagagtttaaacatgaacttaaatacaaatcgctagagatcggaaactatcgatagtgctatatataactatcgatagttttgactatcggaaactatcgattgttttgctaactatcgataactatcggtctattgtcgtatgtcgaagatttgttgctgtaaaccata

SEQ ID NO: 248 - DNA, 548 bp, Diabrotica virgifera
  Annotation=Protein midA homolog, mitochondrial
  SmartBlast Evalue=8E-38; Info=Protein midA homolog, mitochondrial n=2 Tax=Danio rerio RepID=MIDA_DANRE
atcttatctttcagaactttaaatctgaactccaaaccagtttgtagaagaaactctcgttgggtagtagggccaaaggttaggatgccttttacttcgtctgcagcatctttaatagcgctgaaatctacgtctgctgtcaagtcagcggatccaggctggactaagggatccacttgtttgtgtttcttaaatgctctaaatgaatctgttgcgcatctcaaattaccataatcacaaattaacgccaaaccacctgattctttaattcgttcacaaatttctacgtataccatcatactgtctggagatatttcaacatgttcccgattttcatttggtcttatgagtttcttttgcattggagtttcatgtcgagaaagcacatatctgaatttgggctcattaatatcgccatttccaacaaaactaggatcaatatctatgaggacttctctgtatcccttatttgttctgatgaatttgtgaataggtaaagcatcaaaaaattcgtgggctattaaaagagtaaagcactttggtatatc

SEQ ID NO: 249 - DNA, 964 bp, Diabrotica virgifera
  Annotation=Mitochondrial carnitine/acylcarnitine carrier protein
  SmartBlast Evalue=2E-55; Info=Mitochondrial carnitine/acylcarnitine carrier protein n=1 Tax=Culex quinquefasciatus RepID=B0W1I1_CULQU
cattgtgttgggaatgtaacatgtgaggtgcatctctaatcacagccaacaaataacatgcataatgcggtgattaagagtaaaacagtacagttaaaattattagttacaggtattgttgaattagtacatggagcccttatttggtcaaattataactaagaaaatttacgattgtcagctgaaagaaagatttacatccgtcccttggaagctaactgtttttgtagacgtgtatcatattgaaagccctggtcatgtctcttgattttattgccggatgtgttgggggtgtagctggagtttttgtaggccatcccctcgacacagtcaaggtaaatttacaaacacaatgtgcagttaatcctcagtatcgaggaactgttcactgcataaaatccttaatggcaaaggaaggaattaaaggaatatatcgaggagtaactagtccagctctgggagtagcaacgttaaatgcagttgtgttcggtgtatatgccaatgttcaaaaatattcgacaaatcctgagagcctctcatcgcatgcagttgctggagcagcagcgggatttttcactagtgttatttctagtccgatggagctagttaagtcaaggatgcaggttgcaggagcccaagcaggcaaaagtccattggattgtttattaagaatttataaacaacggaaattgcttggagtatttcaaggatatggtataacattgataagagacgttccagcctttacaacctattttgtatcttacgagtatttagccagaaccgaggaaggacaggtcccttcatcggcaacaatattattcgctggtggaatggcaggtgtgatatcttggataataccctacccactagacgtccttaagtcaaaaattcaagtagacacctcaaaacaattttctggagtgtatgattgcttcaagcaaaccgtcaacacagaaggata

SEQ ID NO: 250 - DNA, 773 bp, Diabrotica virgifera
  Annotation=COMM domain-containing protein 2
  SmartBlast Evalue=5E-48; Info=COMM domain-containing protein 2 n=1 Tax=Harpegnathos saltator RepID=E2C453_9HYME
atcaatcaggtgttaattaattaaaaataaacatatcaatactaaaatcatgttaatttccttaaagaaaatccacaaagaacatttacactatttaactctccaaccaagtcaaattgttgaagagttctgtacattagttacagaatttttagataatggcccgaatattgaaaggtatacaaaaattgccaaaaagctggggatagaacaggaaatcatagaaaatactgtttatggcatcacccagttattattacttagttgtaaatataagttaagtgaggcagatttccgagattcagttctcactttaggattttcaactgaacaacaaacagtgttaagcaatttatataactcaaaacaaagcaaaatacacgaagtactcaaagttcccattaaggaaccacactttgatgatttgcggtggaggtttgaggcccaggtgtcttcaagatcactcttacaccatgtagtaccacttgtaactatggaacttacgacgaaaacagaagtcggtggtacttttgagaaagagaagtgtcttctacagacagatcctaataatttattacatatagtgaatgagttagaaagagcattagctgaatctaagagtagacactccagaaagattcagagagctctgaaaagttgaaagaagaaactgcaattgatattttcctattaaaatcataaatagacgggaaatagatttgtaatacattggaataaatatttttaaatgtacacctctttacttatattat

SEQ ID NO: 251 - DNA, 506 bp, Diabrotica virgifera
  Annotation=Ribosomal protein L35A
  SmartBlast Evalue=2E-62; Info=Ribosomal protein L35A n=1 Tax= Chrysomela tremulae RepID=D1M813_9CUCU
acgagatcttcggaatggcagacgcagcggcaaagaaaccgaaggcagagaaaaaggcaccaaaggagggtgcaactccaagtgataaaccctccgttaaaagacgtcctttcaaaagacatggacgtttatatgctaaagccatcttcacaggttacaaaagaggtcttcgtaatcaacacgaaaatacagccctattatctgtagaaggaaccagatcaaaagatgagagttggttttacgtaggaaagaaatgcgtctatgtatacaaagcaaaaaacaggacatgtgttcccggtaggcccaaatctgtcaaatccaaagttagggctatttggggaaaagtcaccagaccacatggcacaaggggtgcagtgagagccaaattcaataggaatttaccagccaaggctatgggacatcgtattcgtattatgctgtacccatctaagatatagttgtttttataaatataaataagaaataaaaaatacgttttccaacac

SEQ ID NO: 252 - DNA, 516 bp, Diabrotica virgifera
  Annotation=Coiled-coil domain-containing protein 93
  SmartBlast Evalue=5E-56; Info=Coiled-coil domain-containing protein 93 n=1 Tax=Camponotus floridanus RepID=E2A5J6_9HYME
tgataatgtcatccgccgtgaaccaggaggtgtataagaagtttaaaaatgctagaaaattgttaagtactgatagtactgattctactgttcaggtcgatgttagagaagatgaagaacaaatcattaaactacaggagattattgacattcttgtagctgctggatactttagggccagaattaaaggcctttctgcattcgataaggttgttggtggaatggtatggtgtatagaatcatgcaatgttgaattagacgttgatctgctgtttagagaaaacttaagcattggtcaaaaaatagctttaacagaaaaaatcgttgcagttttaccaaaaattaaatgtccacgtaacatagaaccacatcaaatccaaggcttggactttattcacatctttccagtaatacagtggttagtgaaaagatctttggaatgtcgcgaagaagtcgctgcatttgtaagagcttgtgccatcgagcagttcaacaaaaagtttcacagtccagacc

SEQ ID NO: 253 - DNA, 1257 bp, Diabrotica virgifera
  Annotation=Coiled-coil domain-containing protein MTMR15
  SmartBlast Evalue=8E-24; Info=Coiled-coil domain-containing protein MTMR15 n=1 Tax=Harpegnathos saltator RepID=E2C3G8_9HYME
tgaaaagtataaagttttctagggatgtacaagaatttttgaggtatgccgaggcatgtgagctcagacaaactttagaaactactaaaaatcatgaaactatacaagaaattggcatgaacgttaaagataaattaaaggctttggaacgtactaatgacgaaatgtatttcaacgcaccccatctaaaacgttttaccgccgagtcagtatattgcggaattttaactaatatttgtgaaatattaaaaacaacatacgtcgaggaggtccaagcatttttagagtatctgatagaaaattttccacgctcacacagaattggtacttggtatatgctattatgtgacatatttacttcccgcaatttgtcaatagaagctgtgaatgttattataacagcactcagtactaaaaaagaatatattttggagtatcagatttatgaatttgcacataaggcgcaacaactaaaaaaacgcaaaatcattgatcagtattcccatgatcaacttgttggattattaccggatcctattcatttagaacagtttcctcaatctgttgtagatgccaaaacaattagggataaccagtctggaagaaaacggcactatgaagtacaccattcagacggaagtaaatcctataaaaccgtagaacaagttgcacaagattattatgttgaaacatgtggttataccgacggcatgcattgtgaaggcacgattataatgaattcgtttacgcttttcttctgggatattatttatagccaaaatccgatcatcccgggcacttttttatctaaatatcaagaagtgccccttgatatgtacaccactgatttctacaaaaatcgcaaagaactaatcgacaaaagattgaagaatatagctgaaggttggacatatgaagtaactattcaaaacgttacagagcactggcaaaattattcacatatatcaggattgtgtggtccaatagttaagactatggatatcaaatttcttaaattgattgtggattgtatcggaagagagatactgtctaaaatttatgaaagattagttaaagatatacatcagtaccaagatatagataagtaccaagatatagatcagatccaaagtggaatgcctgatttatttttatggaatgtagacgaaaaaaggcgaaattcgtggtggttaaagaggaaaatgacctctctataaagcagaaattgtggctgaagtacttaaacttaatcggagc

SEQ ID NO: 254 - DNA, 834 bp, Diabrotica virgifera
  Annotation=Methylmalonic aciduria and homocystinuria type D protein, mitochondrial
  SmartBlast Evalue=7E-12; Info=Methylmalonic aciduria and homocystinuria type D protein, mitochondrial n=22 Tax=Amniota RepID=MMAD_HUMAN
attgtgttgggagtctattttgataattcgatttccactttggaaatcgttctcaaaatgtcgattattcattaaaaaatgccacaacagaagaaaattagctcagaacaaaaaatttaaagtcaatgtcatgtcaatgtcaaagatgatgcaaattctaaattatttacaaatgtcaacattttgtaaaatctaaagatgtcatgtagatatttttcattattacacaagacaattaaaaataataattgtgtagctattctattaagaaattattcaagaaaagtcggaagtggaaataccagtgaaagtccatacaaatatgttaaatcaaaacaacctatagaagattcttgtaatttggtttggcgtgacccaagttttgaattattggctgcaaatgagtttccgttgtttttgagaggtaatattggaattgcttggtatgatactcaaacaactgtcagatctcaacatgagttgataatggaacaaatagatgacagttcttgtgaacaaggagatatggtagtcagaattcagacatgtccaaccttacttagacaaatagcaaaagatttattcccttatagaactttacaagataatggagaattatctgtgattacagttgctttgaaaccaaatattaaggatttacgaaaaaataaagaattggaaactgaaagattagctcagacatttttaattgctgccaaaagtatttgtgataaattaagaaatgttggttattgggcagattttataaacccattttccggacgtccttattttgctccttcggcgttacgggaactttaccaaaacgatgag

SEQ ID NO: 255 - DNA, 821 bp, Diabrotica virgifera
  Annotation=Rhomboid protein 1, mitochondrial
  SmartBlast Evalue=1E-36; Info=Rhomboid protein 1, mitochondrial n=1 Tax=Culex quinquefasciatus RepID=B0X7U0_CULQU
aaacgtcaaatcagctcagcataacctaggaaatcttaaaaatgaatattattttaaacagttttatattatttttttaactatagaattacattgcgactagtgtttctaaattagaccacaatggctttaagtcgaatggtaagattagtacacttaggttcaaaagaaagtatcttcttgcagcgtggaggtctaaaatcggggaatggaaacataagaacctttagaaatggtagaaaagtcaatgatgaaccaaaaatcaaccccgaaagtttagctactccatttactaatgcgcatattgactgtagtaacttacgtgcaggaagtctgtttaggccgtttctatttacagtagcattttcaggatcatgttttgttggggctgctatttgggaatatgaaaacatgcgaagtcatgccaaaatgcagttacgaaagcccatgaagttttttagaaagagcatagaccaaggagttcattccacaaacacccttatcagggatttcaaaagttggtggaatcgtctgaccgagggtgagcgtatttttgctccgatatgtgttcctgaacgtactagtattcttagcttggagaattcctagatttcaaccgatgatgcttagatatttttgttccaatccagctagtccgagtatctacgtgcctatggtgttatcaacgtttagccattattcggggttgcatcttttagccaatatgtatgtcctccatagtttttgtacaggagccgttcatagtttaggaaaagaacaatttttgggttttacttaacagccggagtagtatcaagttt

SEQ ID NO: 256 - DNA, 761 bp, Diabrotica virgifera
  Annotation=Homocysteine-responsive endoplasmic reticulum- resident ubiquitin-like domain member 2 protein
  SmartBlast Evalue=4E-31; Info=Homocysteine-responsive endoplasmic reticulum-resident ubiquitin-like domain member 2 protein n=1 Tax=Camponotus floridanus RepID=E2AZ26_9HYME
gattaacgtagaaaaagctagaagcagtaaaaaattaactgttaagtgttgtgaatatttagtgggagttaaataacaaaaccaagaaaaaatggaatcgtttgttacgttaatagttaaagctccaaatcaacaaattgaagatcagacaatacagtgcgaaccttcatggacaattcacaaattaaagcaacatctatcggaagtgtatcccagtaaaccccctaaacacgaacagaaactaatatattcaggtcagttactaaacgatactgtaacgttaaaagaaatattacgacagtatgagggacaagaagcacacacagtacatttggtctgttcctccaagtatatgcaaaatgttcctgaaaccaaaccagtatctcagactagtacaccaaataatacccaaaatacaactaattcgacgacatcgagtccaaccacaaacgataacgcctctggaggacaaaacacagctggttttcctccaaatatgccatattttaacatgaacagcggccaagttgatccaaaccagtatgctatgcagttggcgtggatgcagcaggcttatttccagtatatgagtcaatatatgcaactggcagcaaattcatatggaacagcaggtcaggcgataccaaataatggagatccagttcccaaccaaccagaacaacctccagcagctcctgcagaagctcccgccgttgccagagatcccgataaccccgaaagagactggctagaagtatttt

SEQ ID NO: 257 - DNA, 1523 bp, Diabrotica virgifera
  Annotation=WH2 protein, Pfam: PF02205
gtaacaggtttaacaggtgctggtttaatagtaactgagctgtacaacttaataacatttttatagggagggggcgagggaaaatcgttcgaactgtgaaacatctgtttgaatttctcgtcaaagtttctacttcttttcggtacgttgttattgctcatggatgaatgcctgggtggtggggagggtggatttgaacccgtcgaaggagctttgttcaactgcatcttgtgtggaggtggtggaggcggagcgtgactaggcgcctgtggtacgataggaggaggaggtggaggagcatggttcggtttcaccatattcacttttggtggaatcggcgtatgactagaagacggtgattgatgattgggcgtcgctggaactggtatcgacggtggtggagctgtcggcctggtgctcagtgcaggcctggatctggcattttgtggggaagaattcgccaacgattggctaattacggaagacatgtgcctgaccgttccaaatttggccatttgattcgtttcagggctttgcggagaaggcgatcggggagacttcaaactatgggctcgacttacgggttttgtaatctttagttgtaatgaattcggtttgccgtttaaaacaggtggttttggagccaaattgggttttccatgattgatcacaggcttaaagggtcgaaggccgttactgttatcagttgtgtccaatgagcttaaatttgcattgcttttcgcctttctgtgtaaagtactctgattaatgctaatattggaagaagagtttgaatttaaggatagctgactcatgtgtaggccgttggttatgttttctcgttgaattatttgccgtccgccagtatctggtggaaaatttctcgttggtgtcggtggaggcggtcccctatttctgttatcatttgctaattgctttttcagttccatctgtatacttccaaaatttttcatacctcctaaaggactaacaggagaaacactaccaccactactagaattaccatttctaagattggcacctaacatgccacccgacatgccaccaatgggcagtttgggtaattgcataccacccatacctccaggtatactgccatttgatggtttattggaagaacctcctaatgctggggcacttcggtcatttgtaactgtctttttcaattttgctcccttctggatagactttaacaaagcacctcgatctacagaactactacttttactattttttgaagaattgaacatcgggggaggcggcgcggccggagccagcggtggaggtgggggtggagcaggcattgttcttataacctatgattctctatttagttatccaatatgcttaatttctaaagtaatttacaataaataactttaattaatcgaaaaaaaaatcattataacttaaaattttcactattttctgacacatacaataaccataccgtcaaagttttgacaaccacttcaaaaagagaagcgactttctaacaagga

SEQ ID NO: 258 - DNA, 507 bp, Diabrotica virgifera
  Annotation=WD repeat-containing protein 4 (Fragment)
  SmartBlast Evalue=6E-33; Info=WD repeat-containing protein 4 (Fragment) n=1 Tax=Harpegnathos saltator RepID=E2BHF6_9HYME
tttaaagtagtgaaacagtttgtagttaatcgttctccaagtaaagcatgttttacaccctcaaatgatatagtagtagctgacaaaactggtgatgtgtatctatacaaactacaggatgaagacagcaaaccagtgatgcttttagggcatttgagtgttgtgttggatattcttattagcaaatgtggcaaatatataattactagtgatagagatgaaaaaatcagggtgtcccattttccaaactgttataatatagtgagttattgtttagggcacaccgagtttgttacgaagattgacattattgataatacattagtgtcagcgtctggagatggtacaataaggttttgggacttcatgaatggaaaacagttggctctgatagatacgaattcgtatattgaaggagacaatttgttgcaaaatttttgtgacgaaatgaataaagaaaaggttgaaattgtagctctacctgttacggatatgcagttacatctt

SEQ ID NO: 259 - DNA, 865 bp, Diabrotica virgifera
  Annotation=Vacuolar protein sorting-associated protein 16-like protein
  SmartBlast Evalue=1E-76; Info=Vacuolar protein sorting- associated protein 16-like protein n=1 Tax=Camponotus floridanus RepID=E2A495_9HYME
aaatgttttataccggatgccagatcagatatttatgttaatatgtgccgacttttgagagttttgaatgctgtaagggatcctaaagtaggaatacccataaccattactcagctgaattatatgaagagaagaaaacaggacattctgaaaagactaataactaggaattattattatttagctctccaaatcgcaaagtatcttaagctgccggaaaaagaaggtaccagttatattttggtacattgggccaaatataaggttagtcagtcccatctcgaagaagaaaccgtagccagagagattgcagataaattagggtattcatcaggtatttcctacagtgaaattgccagtacggcatctgagtacggacgaaagaaactagctataaagcttcttgattacgagtccaaagcaagtgatcaggtgaaattgctcttggaattggagagaacaccccagcgttggtaaaggctatagaaagcggcgataccgatttggtttatatggttatcttaaagttaagagaaaaaatgcccctgggagattttaagatgactataagaaattttccagtagctcaatctttgtacattaaatattgtaaagaacacaacacacaagctctgaacgagatatatatccaggaggacgatttttctgctcaagccgaaacattcatattagagagcttagatgataagaaaaaccatatgaaagacgctctgctgacatctgcccaagaagcttacaaaaagggaagaaaagatctctacgtagctatgtgtgatgaatctgtgaaattgatcagatttcagagggaagttgaagataaaataccaggcgctaagactaaatt

SEQ ID NO: 260 - DNA, 1218 bp, Diabrotica virgifera
  Annotation=Arp2/3 complex 16 kD subunit, putative
  SmartBlast Evalue=3E-49; Info=Arp2/3 complex 16 kD subunit, putative n=1 Tax=Pediculus humanus corporis RepID=E0VEQ7_PEDHC
gtcaaagtgggtgtgtatatttatcactgttgacttttggttttcaaattagtttgttaatttttatatatatattttatatataactgcagcccaatggcaaaaaacacgtttagttctgcctttcgtaaaattgatgtagaccagtattcggaaaacaactttaaagaagacgaaaccgattcagggggctcagttggtccagacgaaactgaagtcaataatttacttcaaaaaggtaaaaattttgatgccttaaaggttgtgctgaacaatgcaccactaggaataaaaaatcagcaaattaaagaaactgcattcaatgtgacttttaaagttttattggcaatcaaaccatcccaaatagaagagacagtgaactccctagatatcgaatcattagatactttgatgaagtatgtgtataaaggatttgaatacccatcagaaggaagcagtggtcatttacttttgtggcatgagaagatctataaccttgctggagtagggtgtattgtaagagtattatcagacactagaagaatatagagattttaattcatatttcgagaaatacaaagcaaaactattatagagaaatgtcttcaaaaaacggggcaattgtagttgatattttgttttgtattactgtgttacttttatcctgcaatggaaaagacttaagctttatttgttcctgtattaatttgtacacttatgatattacgatttcaagtcatctttagtgctatatttcaattatttttgtggctatattatactgaattcatgattttatttctcttgattataaatctacagtatagcttgaaccaatcatccctattgtattataaaaaacaagaattgtttagaatgatagttttcaggaagagattagactaataaatggatcttttcccccaaataaactccattgtgaatagctaatgtatgtatacatctaaaaataagccagttcttctatcatattatttgttgaaatgtttcacatagttcatcattagagaagtacttcaaaacacactcaggaagacttaaaagcatagtaatattcatactaaagtaattaaaataaatatatatgccttaggacgttggtagttttgtattctgagtatatttattgctttttagataagtatcattttattagttttcgttaagcaataactttcatttttacattgtttgtca

SEQ ID NO: 261 - DNA, 887 bp, Diabrotica virgifera
  Annotation=Novel protein
gggccattgtgttgggggactcgagagctcgaactgacgcagacggtgctctccaccagagcgccagacgacaattggaagtcttctccagcgaaatacctgggggacgactgcaagttatcaaaacgcatacggtttcttcgagtaagtggagttcgtcgggcagtagcaaggattttgaaaatttacagctctctatcaatccactggatctatcgtcacaaaaatcgaaagcgtcagttggtagaactgcagtcagacgacctccaacgcgccaacgaacgaaagaacctctccaaccatcgtcagatctcacagaccatttgcgcaacgctcacatcaccgcagcaactaatcttcatcgagtttcacgactctgtcatcaaatacacgaatcagcggtaagacaggcatttgggagaagatcacctcggcctactatatctgatcgagaaagtggagatggtggtgtcgaaatatacgaaatagaaagtgtatcgagtgaaaacaataacagtaatagtaataccgttaatggacatactaaccttgtacgaacaaaaagcagcagtagtgatgacataagtttaataccagagaaagatacaaatgggaataagagcatcgaagatttggaagatctagagcaacttcaaacgtggaggagaacatccaaaataagaagatctctacaatttccaaagcaagcttcaaaaccatctagtcctaaacctgtagatctgccagaaagtttaggcaacgtaagaaagattcgggaggagttggaaaaaggaagaagactgaatacagccttaagaaataacagtgtagatttagatgctttagatcaaattttgcagtcgatttcaagctccagtagtgataaa

SEQ ID NO: 262 - DNA, 3056 bp, Diabrotica virgifera
  Annotation=Mapmodulin, putative
  SmartBlast Evalue=2E-53; Info=Mapmodulin, putative n=1 Tax= Ixodes scapularis RepID=B7P557_IXOSC
ttggtggctaatcgatgcttttctgtcttcgctctcttcgcggttcttgatcgagttttgtaaaagctcagttttgtcaacgaggttacgttttaacgtttttggctccttttttgtgtattttgtgtcgtttgtgttaaaaacgaaacgattttggaatggagaaacgcatagaattggaaaaacggggcagagatcctgcggaaattaaagacctaatcttagataactcaagaagcaccagtatagttggattaacagacgaattcacaaacctgagaaacctgtctctcatcaatgttgggctcacttctcttaaaggcttccctaagctcccaaatctaaagaaacttgaattaagtgacaacaggatagcaaatggactaaatctgcttgaaactagtccaaaattaacaactctcaacctcagtggcaataaaatcaaagatctggagacattagagccacttaagaatttgaagaacctcaagaatttggacctgttcaactgtgaagcaacatcagtagaaaactacagagacaaagttttcaaaatgattcctagccttaaatatttagatggttatgatcaacatgatggagaggcagaagaagatgaagaggaggagaatgaagaggaccttaatcgaaatggaaatgacagtgatatgtcttcagatgatgaagaagaagatgtccgtctttcatcagtgtatgatgattttgaagaggaagatgaggatgatgatgagtatgaatttggtgaggagcaagagggtgaggattacgtcattgaagaggaacttgatgatgaacaggactctgatgaggaagatgtggctctagctgtagctacagatgcatcaaggggaacgaagagaaaattggaggaaggggatggtgagaactaaacccaatctgtgtgcatcatcaatatgtagtgatatataaaaacatttttattaccgaccaatgaagtgtctccaacttggtgagaagagactttttgttaaagtcgtcacccctggctgtggtttcatactttacagaagaaaaattaaaaaaatttaataaataaaatacttttatcctttttgaatacaactgaaaaattctaaattgaatgatcgattccctgcgcaaatacgagcaaaataaatcaattttatgatagtgtttttacaaaggtgtaacataatagcttacgagatcatttttttgtaattttacatgtttgtcgtagaattttagaagaagtgatagtattcttgtagctctgatgaaaggaagactgtctaggtaatatttctcttatgtagatttataagcaataaggtgtaaatattttattagtacagtaaaaaatattttgctgaaaaagaaagatttagtcaaattttaggtgtgtaaattattcaaaaggtacaaattctgcttaggaatttatataaggacaggttaagcacttcctacaatcagaactacaatatggtctatattaatgatgctagttcaaatgttttgcagtgattcccttagacacaggaaaattttacttcttggaagatgcttctgttttatatttgaatttttatacttaaaatgatattttgatagctatatcatggtgcaggtttaccattacagcaagtaaaacacattacagtctatttaaatcgtcttcaccaatgtttcccatgactatcttgaaaacacataatacattgtgaaatggaacaagatgaaactagtggagatgtaaaattgtcgatgggaacctatacatttacattacattacatactttcgcacctttagatgtcagtggcacagttcctacagtgacagtggtcatactccttcgatacatctagaggtgggaaactatgtaatgtaatgtaaatttataggctcctatcgatgagttttgcacctctactgtttcatctctttttatttcacagtgtattatgttttccatcttttgcataattttgtcggttattagcgtgctttcactgtatgctctgttggtgtcctagtcttctatgttatcgattaataaaaactagctagtaaacttagaagggttaataaaggttttcatatattaaattgatctacgatcaattttttctttaattaaaaaagaataaatcaaaaatataagttacatctctactatgtagaggtacgacttgaagaaatgtaaattttataacgctactatccaaacttacatgtgacaattatttaatgttagtacttctatgtatatcgtttagtataagatatctcgcatgtagttttgagatttttgatataaaattgacattagaaacaaacggctggttctgcagctattctttggttgatgagagtacaaaatcattttcaacgtaggtgtaaactttacataaaaatgatcgttcgtgatattttttactgtaggtactgttttatatgtaaaatatgaaagacttttatgaatcgacattccaagggtagaaggggtgattctgttagtataagatgctggctaaggcagttattcacttgtcaattcacgaaatttttttatgaaagatttaaacgaatgtagtacaaatgtattgtaggtatatagaaggtgttgtaaaggttaaggtctgaggattatgtaaatgcagctccagctgaagatgcgattttgtacctacagtttatccaatattgtttattttttataaaaacaatattagtttcttaatgagtgaatactggtttaagtgaaaatcttgtactgttcagttgtctttcttaactacattgaaaactgtaagcatatatgtaaaagatactatagttagtgtgtacacctttgtaaatgccatataggtaaagtagcagccagaaattgttaaaaaaaatgtaatttaatgattatattttgtacatccattattacctaatgtcgtagttttagggtgttaacaatgcatatggattaagttattgttttttattgatcttgtgttatatcatcaactttctcagattaaaatttcttaacattg

SEQ ID NO: 263 - DNA, 1933 bp, Diabrotica virgifera
  Annotation=Ensconsin, isoform E
  SmartBlast Evalue=4E-32; Info=Ensconsin, isoform E n=1 Tax= Drosophila melanogaster RepID=Q8IRC0_DROME
ttcagccttttgtttttcggcatcttctttagcttttttctcagcttcttcttttaatagctttaatctcagttcttcttccttcttaagcttttcttcttcctcgcgtcgttgagtttccttaatggcctcttgcaatctttcttgttccgtctgtctctgtaactctatcaattctcttatttgttcctcttccctctgttgtcgttctaattctgctttggcttctgcctcaattcgtaatctctctaattcagcttgtctctcagcttcctctctaatcagtcttcgtctttctgcaagcgcagctttagcttcctcctctgtattaatacgaaccttcgtcatagaagtcgtcatttcgttctcgatattttcgatagtattaccatctacaactatttgagcctcagacgtgggttctggcttcttaggttctactggcttctcttgtaaaacaggctctggtttctcgattacagacctgatttcgacttctggtgatgtatgcgattcatcaatgctaagctgcacctgctcagacttttgtatctctgttacatttgtatcactcgtttcaggttcactcacctttactgtctctatctctagtacatcctttttgtctttctctattacatcctttttgtctttctctattacatcttttttgtctttctctcctacatcctttttgtctttctctcttacatcctgtttgtcttctaaatcaaccagaattggttctgttttgtcattatctttttctaattttttaacttgcggagattccaaatcactcttggtagtttgaggcacatggacattcgattcgatatctcctgttactaacttaggttcggttgggacatgggtttctggctttggtggagcaattgctacttgaggtttttcggatttatttactttagttgtattattagaagaactatctactcgtgtctttgttttgcttttaagcacaacattttcgctggttgtcggtttcgcaagaagttttttcgtcttcggaaggggtggtttattatcgcctttggcatcagttgaaattccagtcacggcaatactcactggtcttggctttctcggagctgttgtcaaacggtgtctgacgctcgccgaactggccaaactggttgtgctttgttgactgagggaactacttggtcgagatgatgctggtgattggtttagggatttacgggaagaactgataaaatcttttgctggaatggtgggaactaaatcagtgcgccttcgtcctgtgtaaccgcttacacaaccggctggtatagttggtgcattactttcaccggttctctctaatccagtggcagaggtagcacgttttttggtaccagcatctaattctcgttcagattgtcgtcgagtaagcaatgacgggtttgtagaagttactatattttggatggaagtggcccttcgtgtattccaatacgaagcggtaacatcatttggatccagcattcgaggggtagaagaaccaaaggcgaatactgcattactcctttcattgcgtctcctggactcgaatctctgttctcgttcttggtttcgtctaagtataaattctaatctatctctttcagcttcttgtatttgctttttacgctcttcgacttgtagacgtctttcgtcatccctgcattttaaatcatctaaccttttgcgtcgttcttgttctttttgttctttgaaaacttgtgcagcaagagcttgtgccttaatttcttccagtttcctctgcctctcatcattctgtcgatcttttaagtgacgcaatctcaattctttatcaactgtagttttgggttgttctgaaagtttccttgggttttctgccattttatctcactaaaaataaatcagcactgcaaattacaaacacgcg

SEQ ID NO: 264 - DNA, 1549 bp, Diabrotica virgifera
  Annotation=Casein kinase II subunit beta
  SmartBlast Evalue=1E-108; Info=Casein kinase II subunit beta n= 10 Tax=Arthropoda RepID=CSK2B_SPOFR
caattaatttaataatttatttaaggactaagaaattaaaacagttttgcatcttctatctaaaaaaatacagttatactaaatgccaatttgattttcaacatcgttaaatatagatacaagactgtaattgtactatgagattattaatttctctatccattgaactaatctaatatatgcttacagatcttttcctttattcaaaatacgtcaaaatattgtttttaaagcattgaagtacaaatgttgaaaaacagcatggcaaatggtatgaagtacataattttattaactcacagtatcaatacattcatttcttgtaaaattcaagactttgaacaatctgcaggttcatatttgaaggaataattcctattgtcaatttaacggaaatgcatatcactgaaatttaaattttatgcatatgcataaaaaagagaaaaaaaaatgtgtggaccgtaattgaaagaacacactattaaagcacaggaacaatttttctgataaagaaaacaataatgaaggattctcatttttggaaagccagctaatccaaaaatatttgtctgtacagtttatataccctcctgttaaagctgcagttggtagttttagtcattaactgacaatacttacgtcacaagtaacaaaaacgtacttgaagtaacttgttccgtagccttaagtaaatgttccatcaaaaacagccctacctgtgatacattaactagaaacaagataccactcaacagaaacagaatataattccttcaaaacacatttaaactatgttgataattcacttggttacaatttcataagtgttcatatttagcgcttgccgttgttgaaattaatcgtcctcaagggggtcttgaatgttgaggcagcttgttgctgaagctgatatgctaggggatgtattttgaagccaaataacctaggaacaaattgatttgtaggacgtttgggtctatactcaggatgtaccataaacaacatgtgtgggaaaccagtgccaaaataggcaccatctgtatggtgatgtctcgatgattttggtgtatatacatccatacatttaggacagtatgactttaccattgcttcacctgggacatcagataagcctaaaggtaacatttgctgtgattcacagtacactctgggacaataaccaaaatctcctgactgatatttttctatcatttgggctatacccctatttgttaatatatacctagcatgaattaaaccatacaacatctctgcagcttgttcaattaggtcagattggttagggttatcatctaattcatcatctggttccaaatctaaaatcatatctaaagcttgtctataatgtggcacttgttcatttagccctgtaagattgaatttgtcttgaatatagtcttcgtcaacctcgcagaaaaattcgtttccccgcaatccacaaaaccacgaaatccatgatacctcctctgagctgctcatttttctctttgtaccttgattagccacgcttacgttaactcatctacgc

SEQ ID NO: 265 - DNA, 683 bp, Diabrotica virgifera
  Annotation=Prefoldin subunit 5
  SmartBlast Evalue=5E-45; Info=Prefoldin subunit 5 n=1 Tax= Harpegnathos saltator RepID=E2BZV2_9HYME
attaaatcggctgaagactgaagaccctgaattttcttttataatattgataataactaaatccacatacaatggcttcaatatcagcaacagaacaaaaaggaatgcaacagattgatctcactacactgaacgtacaacagctatcccaactaaaacaccaattggacaatgaagtcagcttgtttcaagactctcttgcgtctttgaaggtagcacagggcaaatatcaaacttcaggcgagacactggagaaaatcactgccgaaactgagggacaggacattttagtacctttaactggatctatgtatgttcctggtaaacttcatgacacacaaaatgttataatcgatattggaacaagatattatgtagaaaaggacattgagggagcaaaagactattttcagcgaaaagtcaagtttgtaacagaacaaatggaaaaagttcagtggctgggcatagagaagagcaaaataagggaagctgttattgaaattgctgaaatgaagatgtcacagcagcagcaacaacagccacaacagagctgaatccttagaagtatttaatttgagtctttgttatttattatttcacaagaactctgtgcctcatttcactgcagtttggtttcgttttgtatttagcttctttagtaaaatgacatatttagaaaacaa

SEQ ID NO: 266 - DNA, 790 bp, Diabrotica virgifera
  Annotation=Deoxynucleotidyltransferase terminal-interacting protein 2
  SmartBlast Evalue=2E-38; Info=Deoxynucleotidyltransferase terminal-interacting protein 2 n=1 Tax=Camponotus floridanus RepID=E1ZVG1_9HYME
ggtttactcattataaaaatatggatactgaacttaataacgaaagtgatgctgaactaagtgagcttgaagataacaatgaggaaattccaaaccagatagaggaatcagctgattcctcggatactgagaaatctgctgatgatattgattttgttatcgataaggagggagtgccagactcgacccaggaaaaatcagaaaaagagaagctacttgatgaaatattcaaagattgtccaatttctttcaaagaaaaaaaaccgaaggtcaaaaagattaaaacgaattcttttatcagacaaacacttgcagacttagggtttaatgatgatggaacactaaggagtaaacctcaccataaacagaaaaagctgcttactaagaatcaacgagatgaagttaaaaaagcattaaagaagtcagttataacaccagaattcgaaaaattgcatgtagtaccgcctttggatatatcggagaaaaaattaaaggaacaaagaaagaaagaaaggtctctaaccaaaggatctaaatggtatggactgcctgcaacagaattaactgacgaagtcaagagagatttggaagttttacaaatgaggtcagttttagaccccaaacatttctacaagaaaaacgatttgaaagtattaccaaagtacttccaggttggtaaagttatggactctccacttgattactataataatcgtctaacaaagaaggagaggaagaagacactagttgatgaactcctggcagatgctgaatttaacaaatacaataa

SEQ ID NO: 267 - DNA, 582 bp, Diabrotica virgifera
  Annotation=Golgin subfamily A member 5
  SmartBlast Evalue=1E-30; Info=Golgin subfamily A member 5 n=1 Tax=Harpegnathos saltator RepID=E2B8N9_9HYME
agatgcaacatcaagttattcagagtggtctacaatctactaatcaaagtctggaacaaactttagcgaatgaaaagaagatcagggccatagcagaagaagattgtctgcaaaaaaacaatgaattatataaagcacttcaagagattaatcaacttcaacaattagtaaaatcaaaaacaaatgaaattatgatgtttcaagaggctataaagaataaaagtaatgtagcagcaaacgaagatattgaatcccgaatcaaatctttaacacaaacactgatggttaagcaaaacaatttggagactgtcaccactgaaaggaatgcgttaaggctacaaattgaaaaactagaaaatgaatacaagaaaaattttgtccaagtgaatcgatctcaagccaaaattatcaacataacagaatcagatgattcgataccagttccaaaatttatgcgtgtatccccatttgatgccggggttactcgcagagtcaaacatgcatattcaactcttgatgctgttagtatcagaactggagtatttcttagacgatatccagtagctcgagtttgtgttttta

SEQ ID NO: 268 - DNA, 740 bp, Diabrotica virgifera
  Annotation=Lethal neo18
  SmartBlast Evalue=8E-55; Info=Lethal neo18 n=1 Tax=Tribolium castaneum RepID=D6X546_TRICA
ttgacagtgacaggtgacattacaaaatattgggttagaaaatttattgaataccttcaaaaaggtattaaaaaattataatcctggtcccaaataatagataacaatggttattcttagtactttaagaacattaactcgactgccatcgtcatctttgcgaaatgaagcttccaaaaggctgatgtctgaccatagggtttttcctatgcaaccttctaggtggcaatggatcaaatttaaggattactttcattactatgtaatgttgggactgataccagctactttggctatcacttatgccaatgtgtttattggaccttctactctttcggaaatacctgagggatatactccaaagttttatgaatatcacaggagtcctgtaacaagatttttagccaaatatatttgtaaagatccacaacaagaatatgaaaaatatctggcatacattttcatggaagatgagaaaagaaaacttcgtaaactcgagaaggaagtgaaacacaaaatggccgaaagaaacgattatcaagcttactactatcgaccagttgctgccaaataccacagaattacaagagaagctgctgattacttagaaactatcagaggagaataaatttttccgaatcatctgtaaatatgacattgtttgaacaaatttttgcttaaatgtgtcttgttattcaatagtacgattgtatgtagttaatttaataaatttttaattc

SEQ ID NO: 269 - DNA, 523 bp, Diabrotica virgifera
  Annotation=Pyridoxal kinase
  SmartBlast Evalue=2E-52; Info=Pyridoxal kinase n=1 Tax= Camponotus floridanus RepID=E2AHV9_9HYME
caggatatactgtgagacagttcctacttggaagtgtgaggagattaaatacaaatacatccaaaatactcaataaaatgcctgaaacggctgcaagagttttatccattcaaagtcatgttgtttctggatatgttgggaataaaagtgctgtatttccaatgcagctgctgggcatagaagtagatttcataaattctgtgcagttttcaaatcatacgggatataaagcttttaaaggacagattttaactgaaaacgatttgacggatttagtggatggattatcagctaatgacatcgatgtatattcacacttactaacggggtatattggatctgaatcttttcttaaaaatatcataaaagtagtagaacatcttaaacgcaagaatccagatctagtgtacgtctgcgatcctgtaatgggagacaatggagagttatatgtgccaaaagaactagtaccgatatacaaggattctgttgtaaagttagctgatattattactccaaatcttct

SEQ ID NO: 270 - DNA, 1025 bp, Diabrotica virgifera
  Annotation=Putative ARP-like
  SmartBlast Evalue=6E-50; Info=Putative ARP-like n=1 Tax= Heliconius melpomene RepID=D0AB74_9NEOP
cctactgtaataaataaataataagaaatgtcgaaaaatacattcacttgaaagtatggaacaaatgccacaacataacaaataatgtatgttggataatttaaaaaaaaaatcaccaaagtgaccatttcactaatttatagagttgttaattatacctattatttgatatatgacaataaattaaaatactgataatacagtgtaacgttattaggaacaaaaaaaaatgaagaaactgatataaaaactttcttaatacaatttagaatgatttgttgtataaaacgttctctttggcaaaaaaatatccataacaactctaaaaaccatcagtccaatgagctaatacaatttaaaaacttcctaatttttcacatttttcacagttctacgtgtttgggttttagctcttctatcctcttcaaatattcactcttttctatacatccctcacaatcttcaccccaatcattcaaaattttcttgaggtccctaaccttaagtttcttcagatctactgtctttaaatctatctctacatcatatcggagttcacagatttgtgcgtctttctttttgagtttttcacagattttgtctgaaggcatggaccatgaaagaggctttgacatctcacctagaattccagtcgcactctcctccagtcctcccaaatagtaacaaagtcgatgttccttattttttaatcctttacaatacttcttaaactcagtctcaatctttttgggatcttttcgcgtactttcgtctaaagtggctgagaacttattcaaagttttgatacatacttcacattcattgggtttaagagcatttgcagccaaaactaatgcaagaaaaactaaaatgagtggctgaaattccatttttaatttatctttggtgatatgaaatgtgactatttgtacttgaattagttttagcttcttttgctcattacacgttaacaaaactgtaaaaaccgctgtcccaaaaatgatccaggctcagagctgtcagtg

SEQ ID NO: 271 - DNA, 687 bp, Diabrotica virgifera
  Annotation=Mitochondrial ribosomal protein L48
  SmartBlast Evalue=6E-36; Info=Mitochondrial ribosomal protein L48 n=4 Tax=melanogaster subgroup RepID=Q9VQ35_DROME
ggggccgcaccgatttattttggcagattcttgattctttcatttaaatatcaaaaacaataatatgcaaagtttgagaaaactgcatagactggaaaaagtcttaatgcacgtaaaaaatattcgtctaagatgtgaaagcggaggactttatgaaccaagttatttacaggcaatgaaatcaaaaatccctttatatgaagcagtaaatattcagttacgaggttatgattaccctgtgttagagcattaccaaaaatttgttcataatatgttgaaaaatatggatgttgaagttgaagatagttgggcagttcctgcccaaaatatggatgtcactactctcaaaccaaagagtgagattgtgcatgctaaatataatcttaaaacatatgagagagttattcaaatagcagatgtatcatcaattcagcttccaatcgtcattagagctatagaagcaagtttacctgcaggtgtaacagcccattttagacagcatgaagaagctgatgaagaagttaggtatattcctgatgcagaactgaacacactgaaacaagaattagaagacctgggaggtccttctaaaagtagaaaatagtcttttataatttattttaaccgtaatggttttgtaaatattaatttgttagttagcgaatatttttaataaaacgttgtatt

SEQ ID NO: 272 - DNA, 514 bp, Diabrotica virgifera
  Annotation=Splicing factor SPF30
  SmartBlast Evalue=6E-25; Info=Splicing factor SPF30 n=2 Tax= Culicini RepID=Q1HQQ7_AEDAE
ctccacttttcagctgtagtgaactcagtcattggctttccactaatgccacatgtacctatccctaccctacctgttaccgagtctggtgaagcgaatatgctttttgtgttaagtccagatttcttattctttatcgccttatttgcaaacgctaaccatttcttcttttcaccttcacgctcttcctccaattccttgaatctctgttgcttctttaacttctttttcttcaaatattccttattgtgtagctttgcctttttcatcttttctgattctgagagtactcgtttctggcctgtaaattcacgtaattctgataatatagtaactcctctatttttaaaagcttcaaaggttacatttacctgcccgtctggattgatagcatctatcgtagcttcatagtattgtccattgtcactccacttcgccatacagacgtcacctactctccacattcgcttacacttgtttctagccacaaattcttcaacagcaagaagggatt

SEQ ID NO: 273 - DNA, 584 bp, Diabrotica virgifera
  Annotation=Transmembrane protein 208
  SmartBlast Evalue=2E-39; Info=Transmembrane protein 208 n=1 Tax= Camponotus floridanus RepID=E2AID7_9HYME
gttttgtggatattatgaattaaaccaatatttgttttcagttagttggaatctaaataaattataatggctcctccgcagaagggtaaacaaggtaccaaaggtgctaaacaaattgttgaggaaaatgtagcaacattaaagttttataaatatatggcaattatatctaatgcagtttccttaatagtactatatttacttgactctggtataagtatattactatatatgtttgcctgtgctatttttattggatgctatcagtttatggcatatatggccaaagcaaaatattcagagacaggacagctattagatagtggagtagacttaaacatggaaggaggaattgcagaacacatcaaagacatcataattcttacagcaggctgtcagctcctcgccttgatatccaattatttctggtacctttggttgctagcacctcttcagggaggttggatactttggaagaacattatccagccatatattagccaaccaactgcagccgaaccagaagtaaatgaaaagaaacaaaagaagatggaaagaaaaatgaagagaatgcagagatgatt

SEQ ID NO: 274 - DNA, 763 bp, Diabrotica virgifera
  Annotation=Novel protein
ctgatattcagtatgacttgcaatatcaaaaaactccagaaaaggagctgagcccttatcccattagcgaggattattataagaaaaacaatcgaaccttagcgccatttagagtagaccagaggttaactagtgctcaaaatgccttattaaagagtgaaatggacaagccgaaaagtattctgtcgaataggaagaccggaagccctagagagaggctgatgtctgacttgtatagttccagttttaccgacggtttcgtttaccgagaatcacgctccgacgaactagagagggagcgccttaaaagggacgcgtatcagcgagagttgcgacttcagatcgaagagaaaagaagattgcaacagatgcgagaagagcaggaaaggcgagagagggatttggagaataaaaggttggagcaacagttgttgcggatgcaagaggagaggatgattgaagaccagttaagtgttcatagacaggaacagatgcgaaggcacagcgaggatctgttgcgacgaaagcaggagctccaatcaaccaggtacagttttcgcaaacacgccaattccgaatgcagtattcgtaataatcctaccgatatttcttccaaatcactctcgcattattcgccgccagtttctagacgtaacccatattcttacaacattccatccacatctgtgttcccggaatcatcatcatcatcatctgcaagatataatccaagccgtttcgactgttacagtcggcgtgacac

SEQ ID NO: 275 - DNA, 806 bp, Diabrotica virgifera
  Annotation=NIF3-like protein 1
  SmartBlast Evalue=2E-56; Info=NIF3-like protein 1 n=1 Tax= Harpegnathos saltator RepID=E2BZE2_9HYME
ccttgtccctgtacttagttagacttaactggacttaaccttactttgtttattgttttgttaagcttagcttaagctcgatgctactttctagacttagttcattaaatcggtataagaatttaaatataaaaacttataataattaccagtgctattttgtaaaatatatccaatcaaaagcaatggctgttacaataaatgatgcagtaaggatattaaaatccattgctcctttaaatttagccgagggctgggacaacgtaggtcttttggtagaaccctcagaaaataaaacagttcgttcattgttattaacaatagatttgactgaagatgtggttgaggaggcaattgaaaataaatgtcaattaattgtagcctaccatccaaatatttttaaacccctcaaatccgtcaaccaagaacattggaaacaaagaattataataaagtgtatcaaaaatgatatagcagtatttagtcctcacacttcatgggactcaatgcgtaatggtgtaaatgaatggttatctacagcatttgaagtggaatatagtagacctataactgttaatgcaaacgattcttctgggcgaactggcataggaaggtacatcacattacaatctgccatatcattgaaaactgctatagagttggtcaaagacctcataggacttccttacgtaagggttggtaagggaaggaagagggatttagattcctacattaacaccgtagctatctgtgctggctcaggaacatcagtactcagtggagtgaaagctgacttgtacttaact

SEQ ID NO: 276 - DNA, 893 bp, Diabrotica virgifera
  Annotation=Neuroendocrine protein 7b2
  SmartBlast Evalue=4E-37; Info=Neuroendocrine protein 7b2 n=2 Tax=Culicini RepID=B0W4N0_CULQU
ttccaatttccgcattagtgctcgacccttggggtcgaaaactgttttacgatgaagatcacaattttaatgtgttgtttaacgggagcaatgtgttatcttcctccagccaaggaaagtcttctctctgggctatttcttcgcgacttggtaaatcgtatcaacggtaagggcatctcggaaggggatggagtatcttacttggattttactgatggactgccactagatgggcgctctttatctggtaccctcgaagaagagcaaatgtttccagttgattatgaaacaatgggtgaaatgaacatgcatcccagcattcgtgatcaagaatacttgcaacatagcaccttatgggggaaacagtatttgaatggagacagggatgaaaactcaatactacatcacaacggatttaagaataagaatggtctaaaaggtgaatccactttgccagcttattgcagtccaccgaatccatgcccgataggatatacagctgatcatggatgcattgagatgtttgacaataccgcttcattcagtcggagataccaagcatcacaaaactgtatgtgtgatacggaacatatgtttgaatgccctacctcaaatgatatttctgatgacaattccatggatatgatcgacagttatcattttaacaagatgttacaacaatcggctaagtctaagaacaatcccttttttaactggagaaaaattacccgtggcagctaaaaaaggcaacaatgttttactgtaaacgtacaacaccaacccccaactatgaaccaatccggacgacaacaaataatgactttggctatgaacatggacgatccgaagaacaataaccattttaattcttacccctgtacgataaactatat

SEQ ID NO: 277 - DNA, 791 bp, Diabrotica virgifera
  Annotation=Class I helical cytokine receptor member 2
  SmartBlast Evalue=1E-18; Info=Class I helical cytokine receptor member 2 n=3 Tax=Tetraodontidae RepID=Q6UAQ4_TETNG
tgactttaagatctttttggaggaactggcaatctagacctttgtaagcatcatgaaaattgacaactaaacgtttatcttcgtgtacatttcctagtgccttttgaagcctaaattcttctatatcagttaccttttcttcattatcaaccacaactttccattctactaaaactgctccaggtttttctgttaattcagctacctgtactggaggaatcttataaatatctcctaactcagacaatttatccactatttcaatttctagagatggttcataactaaaacttatataaggcacttctttgagctctggaacttccggaagagttcccaataagcttgcattttttgaaaatatttccatatttttaaattcggagctaattattgctgacccagtattaattaatttaactgtagattcaattttatctaaaatcatgctgcggcattctcttagaggagccagggcttcaatttttgtctttttggctttgtccaatagtatcttttctcttttattaagggcttcgataaaggcttccttaaaattacaaaaagttttgctaacattggcctctgtttcttcaaatgtacttagaatttgtttcattgcatggtctagttcactatttaaccattttaatcggctaaggtatatattggccgcttgcactgtatcatgtacttctgtattattcatttttagtcgtttttaagttgtttatgagaaaagtatgaattgataatgaaatgaaaaatgaaaatgaaatgaatagatgaat

SEQ ID NO: 278 - DNA, 745 bp, Diabrotica virgifera
  Annotation=CG8675
  SmartBlast Evalue=2E-32; Info=CG8675 n=6 Tax=melanogaster subgroup RepID=Q9VX62_DROME
ggcccaacacaatggtgcagtttgatgttatttttggggttattaaaaggattttataaattgatctattaataaaccatgagtactcaaaaaggaaatactggccgtactcgaccccagaaacacaaaaatcgttcagctttcaaaaataatctccatgataccaaccacagaaccaagatgatcaactctattcaagttagtgatgtatgtgctcgatgtaaagatattatagaatggaaaataaagtataaaaaatacaagcctctgacgcagcccaaaacttgcaataagtgtggattaaaaacagttaagaaggcataccatgtcatgtgctcagattgcgggaagaaattgggagtatgcacaaagtgttgtgagaaaagggaagtttttgtggctgaaccaactgagaaacaacaggtgcaattggacaacgaacttaaagctctgttacagtcattgcccgaaagaaaaagaagaacattcatcaggtatatgaataaaaaagataaagataaagaggtaataggtgaagataagaaattaaaagaggcaacagaagctgaggatagaaaagatttgttaaataagttaaactctttgaaagtcaatgaggatgatggttttgacgactttgatgaagatgatttttctgggggtagcgaggatgaagaaggcagtgaggacgatgaagatattgaggattcttaacattaagaaaatataaataaagatgggtata

SEQ ID NO: 279 - DNA, 431 bp, Diabrotica virgifera
  Annotation=Novel protein
gaagtctgtaaagatttaagcatgatttaacgaaatattaaatttttaactttaaaatgccgaactcagatattgatgataacgaaaaagtaactgggcccgtcgacaatgcatgggagctgaaaattccagaattcaaaccagaagataatccacatggattattagaggaaagtagtttcgccacattatttccacaatacagagaacaatatttaagacaagtatggcctttagttaagaaaactctgggtgaatataatataaaagcagaactagatgttgtagaaggtagtatgactgttaaaaccacaaggcaaacatgggatccttacattattattaaagcaagagatgtgataaagttaatgtctagaagtgttccctttgagcaagccaaacgtgttttagaagacgatgtaggatgcgat

SEQ ID NO: 280 - DNA, 418 bp, Diabrotica virgifera
  Annotation=Dolichyldiphosphatase, putative
  SmartBlast Evalue=5E-44; Info=Dolichyldiphosphatase, putative n= 1 Tax=Pediculus humanus corporis RepID=E0VVJ1_PEDHC
tttctgcttcttgcatggaccttcttttctggtgttggtatactcaaaccataaaacatttggtataagtgttgtgtcccttaatagaagtaattctgatatactccaggtcacaacttgtgggaataatggagcaagaactaagtaagtcagagcaaaccaaaatgttgcaaatagaatacctactaatgctccataaagcacttgggatactgtgtgatactctaagtatattctacttatgctgactaagatggccatagacaaagatgaaaagattatcaaaaatttagacaaactttgtatgatagtgttgttattcatatgctgtaaccttatatagacaaaatatatcacatatgttgtaaaaaaccatacaaattgtgcatgtgatgatggcataccatattctacataa

SEQ ID NO: 281 - DNA, 1095 bp, Diabrotica virgifera
  Annotation=Low density lipoprotein receptor adapter protein 1
  SmartBlast Evalue=2E-27; Info=Low density lipoprotein receptor adapter protein 1 n=1 Tax=Camponotus floridanus RepID=E2AJD2_ 9HYME
ttttattgagcgtgtgtacactttcttgcgcatttgtttattaactattgtaccactcggttgaaaaatcgctaagcctactttggattcggctttcgagcgataatatagtacggagaatagttgaacagtagtttagattctgtgaggcagtttagaactagaaatccaatttaggtgccatggcctttttcaaatcgatgtggaaaccaaactcgaagcacgaaaagctttctgaagaattattttcaaagattaccaaagaacccaaacaagaaaatgtacctgaaaatgatgccaatacatttaaattaaaatatataggttgtacaacagtcgaaaaagtaacaggagataacgtcagttcggaagctgttaagactatcatcaaaaacgcgaaaaaacttaaaggaaaaacattggcaaatgtaactttacatatatccgaaaaaggagtcatagtaacggacgcagaaggaaacgatgttctcaaaatatctatttatagcatatccaactgttccactgactcatcccaccgacaactattttcgttcatatcatcagacacaaaccaagtaaacacttgccacgcttttctttgtcccaagcgaaaagtggcccaaaatgtgacgttagccgttgccagtgccttcagcacagcctacctcgattggagccaacatacgatgtctagcgagggaatgaaaataccgttcagtcgaaagaaaacgagaaaaacaatctaaatcaaatcaataagtctgaagttataatagaagaaaagcttatcgattttgatagtgagcctacgacggaggatgatctgtttactcttgaaagtcaattgcttttcaacaaaaatgactgggtttcgtttgatgatgacggtttcgcagaccccagcaagctcaaatttttccagtgatgatctcgccaatgagaatacgttccatacacataccttatattaagcttaaataattaagaatttagtcaataaacctgtaggtatatttattttactgtttagtaatcagtgataaacttatttgtagtcattttttattttacgtaaaaataaaagaaaatata

SEQ ID NO: 282 - DNA, 857 bp, Diabrotica virgifera
  Annotation=Formin-binding protein 4
  SmartBlast Evalue=1E-23; Info=Formin-binding protein 4 n=1 Tax= Camponotus floridanus RepID=E2A1A8_9HYME
tgggttttattggtgtcaattcgcttatatccactcctggaggatgaggctgaccgttgtaggtgagttgtggcgtgacggtaacgggactagcaggaacagggagaggaacagtatgtacaacaacttcctcgtattcgacgcagctgataactggtggaggaggcggggatggacttcttatcttgggtggaagaggtggtaatacctcttcgggaggcggcgattcaatctcgtgtggcggaggcggcgttgtggatatatccatggccacgtcgctagtgttcatatcgggctgcgggtactcccactgactagttccggaaaatctgttctggtagaaataccttctgtgtgtcctgtcccattgtagcatccatccagtaggtgccgcttctttttccagtttctttaattctgaacaagtatcatctaaccatttttttagatacgatctcttcagtgccccatcattcatggcaaccacaagagtctcagcttgcactaacatcacctgtaccgaagatattgacggtctaccttcattcaaaaacgttaatttatcctttaaattactgtatgtattatcaatgccttctctatcgattaaatcgtcttcctctttaccattagattcttcgttcctggtaaatgaaggcaatagaacatctgatttgacaaaagctacaccacctttcttgaaaccaggatatagattatcgttcgctctttctgaagtagctacattttcttcgaaaccaaagcctgttctgcgttcctcatcatctccgctttttttcgcaacggtcacgactggcactgacaacttcttctttctcataaataatttagtatca

SEQ ID NO: 283 - DNA, 891 bp, Diabrotica virgifera
  Annotation=BRCA1-A complex subunit MERIT40
  SmartBlast Evalue=2E-30; Info=BRCA1-A complex subunit MERIT40 n= 4 Tax=Xenopus RepID=MRI40_XENLA
taaatgttcccgaaaaaattattttagttatagatagagctcaagatgaacattgcacaagttttgcagaagccaacggtaaatacacaccattgtcaatgctcagaaagtctctacatctgttcgtaaatctgaaacattcgatcaataagaatcatgagttcgctattgttcttctgaatgaaaatactgccacatgggcactacctttcactagtgagttgagaaaagtaaataattgtattgaaaaaataacacagtgtgaagttgaagatacatttaacatgaatttagtttttgaagaaattttacccaacattaagatacctcaagatgaaatcgctccaccttatataattcgtactataatatgttacggaagatcatacacaataccagaaattaaattctcagaaaaaattgtgaaattgttggacaatccgttttttatttgtgatgtactgatgacccatgaaccagtcgatgatagtaattattgtaataaaatatttgaatgtttacagaatattgatagaaaaggtatatcatacttttttccagtgggtagaagtgctttaaggttgcataattcaatggcaaaattactaggacacggtttacaacgaccttttcaaacatttcacaaagagtaaatagttctctgagattcatgtcaaactataggtatgttcctttgttgtcctagttctgaaaaaatgttaacaaaatgctacactaagtcgttcatttgcaatgtgtagtggtacactaccatgttccattgaaaagtgtaacactagtgaagataaattaacacctgcttctgagaggatgactatctatactcgtcttacgcagtaacattcaaccaagttaaccaaaactaaagta

SEQ ID NO: 284 - DNA, 459 bp, Diabrotica virgifera
  Annotation=Ribosomal protein L31
  SmartBlast Evalue=1E-55; Info=Ribosomal protein L31 n=2 Tax= Cucujiformia RepID=D1M815_9CUCU
caaacgtcagtagctcgagtaagttaagtatggccaagcagaagggtgataaaaaaggcaaatctgccataaatgaagtagtaactagagaatatacagtaaatcttcacaagaggttacatggtattagtttcaaaaaacgtgcccctcgtgctattaaggctattcgtcaatttgctttaaaacagatgggtaccccagatgtcagagttgatacgagacttaacaaacaactatggtccaaaggaattaggaatgttcctttcagagtacgtgtacgtctttccagaaggagaaatgatgatgaagattctgtgaacaaattgtacactcttgtaacatatgttccagtagcaacattcaagggtttacagacagaaaatgttgacgcaagtcaagaataactaataaatattttttaagtaaaaaaaaaaaaaaaaaatcggtgcggccccaaca

SEQ ID NO: 285 - DNA, 1142 bp, Diabrotica virgifera
  Annotation=Reticulon; Pfam: PF02453
aaagttttctgacgttgtaatcccttactttagtaagagaatagaaaccaacaaagaacaaaaagtcggaaagtatggacagtattttgagaagatctacgaagttcttagctgggaagatactcgctacagtttggtagttttcgttgtttttaattatttattttggttaatggtccaatggcagatcaaaatcgttggtctcatattctttatattgttaattctctttttgttcgacacatttttcccacatacgaggcaaatagaacaaccgataaagtcagctgatatggtggataatacgtatatagtgataatggacatattctacggcttgaaagcttttaggaacgaaaattcgctcactttctgcgtgggcatgtcgatagtgtttttgattataaacattattgcgagaagcgtatctggatatctaatatgctacctactcttattactaagtttcttcgtaccattaggcattaaattactaccagaagaagtaacctcgaaaatagccaacggaattaaatatacatttaacgtaaaaggtacattagccgaagaagaattggttccttttatctgcgacaaagattttaataatagggatgctgatttggacagtctatgtactgatagaactgcagattcagtttcaaattcgcttatcagtggaataagcacgatgccttcatttctcgacatggcagaaggcgatcgagatatagaagaagacgatctcataccaccactaactccaagtgatatttctagtgattcagacctagaccataaagaaatgagtatcgattcctctcatttcaacggagatagctcttcagaagaagagaggtttctagataacaccacagtattccccacagattttacagatgattctggaagcgcatctcgatttgccagtgtcagatcgaacatcggtcagttagtctcgaacgtttggagttacgcagggtctagtaacaaacccgagatcaagagacagaacagtagcagcagcagtagtgagttcgaatttgttagttcatcggatcttaaagaataaggctacgtttcgtctaaagtttttcggaggaaatcgtgtagccattttgattgatttagcagcttcagct

SEQ ID NO: 286 - DNA, 737 bp, Diabrotica virgifera
  Annotation=Circadian clock-controlled protein
  SmartBlast Evalue=2E-25; Info=Circadian clock-controlled protein n=1 Tax=Camponotus floridanus RepID=E1ZV41_9HYME
agtttaaagagtggtttaccatgaaatcgttactgctagtgatttgttgttgcgccttttacaatgtggtccaaggaagaagcttacaacaattacctgaatatttacagaaatacagctgcaaggaatcagaaccagattacggaaaatgtgtctgggaagggtttcacaatgtctggcctttcttcatgaaaggaattccagaattaggagttctaggtctggatcccttccgaatgaaaatgtttgctgttaacagtactgttggtaatttgataaaaatagatgctgtctgtgaaaatgctgaagttactggattggcaaatacagtcattcaagacttaaaggctgatcctattaaacactacggtgaaataagattgtttattccatggatgtatgcaaattttgactatgatgttaaaggacaacttttggttattcctctagaaagcaaaggacattttgaaggaaacttcactgaaacgcaggtgttagtaaaaggtgatttaaaaacttacctcaaggatggggtagaatattttaaaacaggcaagctttatctaaaagctcgaattggtaatggatgggtgaaactgacgtccctagaaaaggaattccaatatgcagctgatataattaccgatttctacaatgaaaatccccgtcgagttatggacgctattaaccctatattcatccaatattccaaagcttttgcaaggcaagaaatggat

SEQ ID NO: 287 - DNA, 515 bp, Diabrotica virgifera
  Annotation=Ribosomal protein L28
  SmartBlast Evalue=1E-54; Info=Ribosomal protein L28 n=1 Tax= Chrysomela tremulae RepID=D1M841_9CUCU
gtttccgccgacaaaacacgacaccatcttttcttttctaaaactgaggttaggaagctcaagatgtcgtcgcatttggtgtggggaattatccgcaataacaatgcttttcttctgaagaaaagaaacatttccaaaccttttagcactgaagctaacaatctcacaaacttgagctcataccgttacaatggtttgatccacaaaaagtctgtaggaattgtagatgctgctgacaaaaaaggattcacagttgtttacaagaaggccagcaaacaacacaaacctaaacaaaacgttgtaaagaggacaatgaagtctggccccagaagatctttacataagttaaagagattgttgaatgccaacaaatacagaacagaccttaccaaggctgcccttcgcagagctagtgcagttctaagatcacaaaaacctttaccagccaagaaacagaaggttgcccctaaaaaagaataggtgtattttttaatgtaataaacaaatttataaaa

SEQ ID NO: 288 - DNA, 960 bp, Diabrotica virgifera
  Annotation=Transmembrane domains-containing protein
  SmartBlast Evalue=4E-21; Info=Transmembrane domains-containing protein n=1 Tax=Ixodes scapularis RepID=B7PH88_IXOSC
atccgatgaaaggaaaaaatcttctgtactgaacgtagagcaaaaggaatcatagcaatagtctacgtcttttgctttgttaccacagcatcaacaacattcgaataccagctcacctttaacgacatctgcgttaaagaatgtcccattgaccaattgaactatacagagtcccctcatttagaatccaccagtgcaagtgtcggaaatattacttatgttgagtctgaagctagcagtcttggttcagatgctttaggctcagttgttatcaaaggttatgataaatatattcagaacaagataaaacaaatcctctccaattgtactaatcatccacatatcattttggttcctgttaatcctaatgttttaaattctacaagtaacgtggattcaattaataggtccctagaggcagatttaagtcgagcattagaaaaaaaaaaagcaatagcacaagtgccgctagtactcaccatgtacgaagtcttaaagaatctgagaatagtacttattgctgtgaaaaaaacttcacgatcgatgtagagaatacagaattaggaaagaacaaaacttatacagactttatttattggtatagtgcactgttttttgccataatacctttactagtgatagcaacgtttaactgttttttaatcagagtagtgtattcgtcgcagaagaccagaagagtgatgacaaactctcatgaaagttcttcatggacaaacgaaaaaagaataacgataatgctgataggcattgtattcgcttttctaatatgtcaaattccaacagctatacacattatctactatcattttaatgagacaaaaaataaggtgcaaatgaacataagactgattttaggtaatttctgcaacttcatggtgatgctgatggcaccctgcaacttcctgatttactgcttattgagacaaaaaattccgaacg

SEQ ID NO: 289 - DNA, 808 bp, Diabrotica virgifera
  Annotation=N-acetyltransferase MAK3-like protein
  SmartBlast Evalue=2E-42; Info=N-acetyltransferase MAK3-like protein n=1 Tax=Camponotus floridanus RepID=E2AH51_9HYME
gataaggttaaagacgtatcaaacaagtgcattttaaacgagaaaccactagaactaaagaacgggcttgtaaatggaatagtcaatgtgaataattcttctggaacaaagaaaaatgccaagaaaaaaggaatactcatcatatactagatggtgtacatattcatgaaacagatgagaactgcattgtcaatgagaaggtaaaccaaagcaaatcggatgacattctaaatgaagatgtaaatagtatagatagtaaaaatggctctaaaacaagtctagactcaaatgaaaacatttcttgtgataaacctccccctgaactgctattagaagctctaaaggacgctcaaccaggttcaagtgaagtggatatcagtgatatagatagtttgaaaaacattagtttagagagtaaagatgaaagtgtatcctcaatcgaaactgataatgcactagctgttaagccaaaaatagattttatacaatatgaatctgaattgcagatgccaatgataatgaagattatccaaaaggatctgtctgaaccttattccatttacacatatagatatttcattcacaactggccaaaactttgtttcctggcaatgtgtgaggatgaatgtgtaggagcaatagtttgtaaattagatatacaccgtaaggtcatcaaaagaggctatatcgccatgttagctgtcgaccagaagtaccgcaagctcagaatcggctctaatcttgtacaaaaaggccattaatgaaatgcttctaggcgatgctgacgaggtcgtgttagagacggagg

SEQ ID NO: 290 - DNA, 615 bp, Diabrotica virgifera
  Annotation=N-acetyltransferase UNQ2771/PRO7155-like protein
  SmartBlast Evalue=8E-36; Info=N-acetyltransferase UNQ2771/PRO7155-like protein n=1 Tax=Harpegnathos saltator RepID=E2C870_9HYME
acaaaagcagccactactctatcacagatattactattcaacttcaaaatagttattatgacaaaatattatcaatcatccaaatttttctgtttaataatgaaagaaaattttcatttggttcgatacgtttattaagtagtatcacaatggcagatataaattggtaccaatccaatgggaaatgttcggggggatcttctggcaagagtgaaagaattatttccttatactctttggctgatgtacagctacggtttttgtgtcctgaagatttggatgaggtgagagccctgtgtcaagaatggtttcccattgagtaccctttttattggtatgaacagattacttctactagtggtaaattttactcgttagctgccgtctacaaccatcaaataatcggtttgatcgttgcaaaaatcaaagcgtacgaaaatttaaatgacgaagacaagggcattttggcaaagtccttgtccgattcagaaatagcgtacattctgtcgctgggagtactcaaagaatatcgaaggaatggtatcgcctcattgctacttgactctttactgaaacaactcgtaactcctgaaaggcgaagagtcaaagcggtgt

SEQ ID NO: 291 - DNA, 693 bp, Diabrotica virgifera
  Annotation=Protein rolling stone
  SmartBlast Evalue=8E-25; Info=Protein rolling stone n=5 Tax= melanogaster subgroup RepID=ROST_DROME
attcaataactagataggtgatgttatacagacaggtacaagtactaaatattttctgcaaaattttgatacctgtccacttactgtgttaaactatgttaacaccactttggagggaccattttgcacccaaaaacttttatttacttcatgatgatccaaatgtatttcttacaagccaatggcagagaaataagactgaacctaatatcaagtaccttatataccgcacaatcgtaatgttaatattttttattacgtggatactttcaataatagagggcagtggtaaaggcaaatatccaatttatttaaccaattggggatatacgggatgtacaattcaagctcttatagcatttttgatgctgtttatggcagtgctggcaactaaatacaaaagtatgcacaggacaaaggaaaagactctaaaactgtatcctgtttactggttattaaacactgtagcgacatctactgcttttgcgattaccactatctactggtctgtcatatacaatcctaaaaaagttacgaatcccgttattaattattttgttcatggaaataactcactgatggtgttgttagatttatggattgtaggacacccaattagaattttgcatgtgatttatactgttcttttgggagttacttatacaatatttactttaatttattattctgcag

SEQ ID NO: 292 - DNA, 620 bp, Diabrotica virgifera
  Annotation=39S ribosomal protein L32, mitochondrial
  SmartBlast Evalue=8E-38; Info=39S ribosomal protein L32, mitochondrial n=1 Tax=Culex quinquefasciatus RepID=B0X3C1_CULQU
atttctactatcctttttccctcaaagaattccgctggtttgtcattttttttcgccttcatataaaacaacaatctctttttccacaggttccaattttaattcgttttgaatctgctcttgcattgcctttgtttcatcaataactttcttgtagcatgttggacataaaacaccagcctcgtggtcatcaccacacacattacaggtccttaaatccttcctaggcaataaaattttcaagacataataaggatcaccaaattttcttttccatcgtttttctactgagcgccgatgtttaggaactgcccataaaaatccctcgcctattatatctttaatagaaaatttgggcaaattctgaggacttttgtttaattctattcctgctaggcaaagtgcatctggtggaaaacctcttccaaaagtattaagtacatgatgcttcaaattttgaactgctaaattaattcgcgtcaaaatagtagcagacattatcttgcaggttagaaaacgtagaaatcgtgattggtatggtaatggtaaaaggcgctcgaggtagtgggactacggcgacgtcgtgtttgttggtggaaaggcgcttgtgaggtgctccg

SEQ ID NO: 293 - DNA, 489 bp, Diabrotica virgifera
  Annotation=Transcription initiation factor TFIID subunit 13
  SmartBlast Evalue=3E-48; Info=Transcription initiation factor TFIID subunit 13 n=4 Tax=Apocrita RepID=E2AU31_9HYME
atccttatgtcttggcattacctgcaaatttaatttcatcaaaagcctttcttgctctcttgagctcttcgttcatagttagtaaatctttcacccttgcatatttcctagggtctttacgaactaaaaatacaatgtcttctacttgtacccggccagtccttccaatttccatagccttgtgtgtcatttctgttatgaattcaatgaccaggtcttcaattatatccacactttctgtataaggattctgatcgtctccaaaaccgtacatcatacatcttaattctttactgaagagtctttttctacctgcactacttagggctaatgctgtttcagctgcatcatcttcttcaaattgttcaaaggcttcctcttgtgccatttcactgtctcttctgtttgtattctcgatcaatgaatagttaaaaaaaatctataccccttgaaatgttgctttttttgtattttacaaaaaatacaaac

SEQ ID NO: 294 - DNA, 451 bp, Diabrotica virgifera
  Annotation=Phosphatidylcholine:ceramide cholinephosphotransferase 1
  SmartBlast Evalue=9E-41; Info=Phosphatidylcholine:ceramide cholinephosphotransferase 1 n=2 Tax=Aculeata RepID=E2AM13_9HYME
acaagagagatgcaagacgttattagctgcaatagttaattgtttttagttttgttttaaccctaacttcactcagtctagtacacgaacgtgtacccgataaagaggtctacccacctcttccagatgtgttcctcgacaatgtacctgcttataattgggcgttagatgtatcagaatatataattatattttctgtaaatactagtttgatagctatgatatttcacaaacatagatttatcgtatttagaagaatatttttgttaatgtcattgttatatttgtaccgagccattacaatgtacgtaaccgtgttgcctctatcgaatagaaactatccatgttcaccgaaagcaaacggaacgtcgccactgatgatagtcaagagagtggcgaaactcatgtccggtatgggattgtcggtgaatggtcagcacgtctactgcgg

SEQ ID NO: 295 - DNA, 716 bp, Diabrotica virgifera
  Annotation=WD40 repeat protein
  SmartBlast Evalue=2E-26; Info=WD40 repeat protein n=1 Tax= Glossina morsitans morsitans RepID=D3TS49_GLOMM
tccattgtgttgggggggtgttaggttaggcgttaggccgattcaaatttggatagtttattttattattacagtttatagttcacatgataagtattgcattggtaatttgagtccatttcaaattcataacaattatgcataatatacctgatttactagtaacaacagcacaatctgatcaacaattttctgcttgtttatgggactataacacacagaatgtgcgaaagtactataaaaacgggggcactgttgcccctaaatgttttgaaataataggaaaagattattttttgtcttcaaagctgggtaaaccattcttacatttatggttgttaaacagtcaagatgtagccaaagatataagacttgttctaccagaaccagcaaattgtttagctgtctctccagaaaataattttctagctgtaggaattaattgcaaactttacatatggcacctttcatcaggaaaacttttatctatacaacaaaagaactatcaaccaattacctgccttaagttttcaagtgatggaacacttttgatattaggaggccaagatggaatgctgattgtatactgtgtaggtgatttggcaacacttgcgaataattttatgcaacaaactgatattggaaaagctgaaccactctacataaaaaaagatcatccaatggtgattaaagatatacatgttgctttccgccat

SEQ ID NO: 296 - DNA, 522 bp, Diabrotica virgifera
  Annotation=Mitochondrial 39S ribosomal protein L27
  SmartBlast Evalue=2E-38; Info=Mitochondrial 39S ribosomal protein L27 n=1 Tax=Culex quinquefasciatus RepID=B0X4E4_CULQU
taggttaacctaaactttaggatttattaaaatgaattttacttttaattatatcaaaacaaccgtattaaaacccacagtcacagctgctattcaaaatattgtacggtttgcgagtaaaaagacaagcggcagtacaagaaatacgagtacaaaagtcaggccaaaacacagaggtatcaaaataccagatggtcgaaatgtaaatgctggtaatattttagtccttcaacgtaaccttcgtttccatccaggtttaaacgttggtatgggtagaaatggtaccttatttgcacttcttccaggaagagtttcagtgacatgtgaaaaggttgatttggattgggaccacacatgggtccagagatgccacggatatagaaaaggtgtagatttttacaagaaatactttaatgttatacctataccacagcatcaaaattttaaacttgttaatgaaatctaggtaatgtgatatattagtaattatgtattttaaataaaacaagtatgatacaatca

SEQ ID NO: 297 - DNA, 1343 bp, Diabrotica virgifera
  Annotation=TMEM9 domain family member B
  SmartBlast Evalue=2E-53; Info=TMEM9 domain family member B n=1 Tax=Anopheles darlingi RepID=B6DE27_ANODA
aataagttgttccatatcgtgaacactaaagatgttaaaaaaatcgaaaacagatagatcactggaactcatccaccttactccacagaacctggcactctcggattactgtcatttcactatatggaagcactcattgagcaagcagctcttttataaagataagaaggtccttgttgactcgtttagatatgtataaaatactatacttataatatctctcacttaacttggagttaggctttacaatttttttatatcttactattagatacgtattcggattattttagaacaaagcgactcaataaatttcagtctataatttacaatttttcgatatatacaaaaacattgcattaatttttaactaaaactaaaaaatttgtatttgaaattgataattattattataaacttccactgttttactcggaaaagggttgttgctgtagaaactctgtcgtttgttgaaaggacttatgggcagtaactttcagctatagtttaccatcacaataaaatctgaatgtgattaactaattaacattgctgatataacattttcagatttttcaaacattaatttgcattacaccatttttcatatcgcttgtgtcacttgactcactctttgataggttaaacttttcgcttttagctcaaaaaattgcaatgtttttgatatattagatacagaaaaaagtttaattcaacatggtatgtcggtcataaatattttttctttgctctttgacttgtcgtttccatttgtcttgttgatgtccaactctgttcaagacgtttcctcttacgctcatgttgtgggacattggaccagcagatacgtcatcctcttcatttgtatgctcttggtagtttcctttaatcctcttgttcagcagcgggtccagtatgatcaagaatgccatgtatatgaccaaaatcgaaataacccaaattactataatcaccactactttaattatagtagtgtttctattttcatatttgcattcacatcttggacaaaattcttgttcttttcctataatatcttgactaatcctaggtagtataacttcatcacaattgcatttatttggtggtacattggtaatgtataaaatcctagatgtgtggttcttagattccgtcttattcgttactactgaggatatactggggcatatacacttacatctcttgtcttcataggattgtgccgtagataatgtaagtgtagttgctatacagaacactagcaagtaatatttcatttttacacttgtgtttaaatcttaacagtacataatataaatttaattaattctctaaattcc

SEQ ID NO: 298 - DNA, 1790 bp, Diabrotica virgifera
  Annotation=Novel protein
tttcggtccggctctgcatatcaaaggtgcgaatttagtcattaaattgccaaattttccatttgtattctctaaatcattcgtttggtaagaagatggcagacttagatgatttctttgccaaaaaagaccgcaagaagtccaaaagtacaaaaaaatatgctaccactgaagaagttgccaagaagctagaagacactgcaaaaaagactgacaaattaaagaaagaacgtgttaatgagggcgaagatagtatagttactgaacaagaccaagacgaatggaaggacttcgaggaagaaaagaaagactacacagggttaaagataggaaacttaaccatcggtcaaaattcggaaagcagtactacgggagctaaggaaagtaccgaacagcaacaagaagatgagcctggacaagatgtagacaagaaatctggaccttggaaacgcatcgacgtcggggaagcagcggaagtggagaaagttgaatataaaccggaaccgatacttcctaatgtatctaagactggcacttatatacccccaagtttacgatcttcaggacaaacccaagttcaaagtactaggctgaatagaacaaaagctgctccagatatccataacgaagaatttttcccatctctttctggtgatcataaaaaaaaatcgtagcgaaggatcattcgaagtagtgcagtccaatagatcgacctcacatagacaagcggaacaatccaagataaactctgcgcaaggtcccagatggaacctcgccaaccgttacaatactctaagtagtaacgagagctagtgacgttaataatccatagagaccaatgtgtactgtgtcgagagaggtggccagcgataaaaaaatgttacttacgattgattaaccaataactttgaaagagtcgcgtctgttaattttttaatggagacttgagtgggccctcgatgttttctgtttccaataataacgtataatgattccctttgtcaaaaagtttattcagcaaatgcaggtcgtattctcgaaaaagacacttaatgctcataaaaatgattgtatcttatttcatagatggtataataattattctttgtcatggtatttatttgagatttccaaaggatgtggttaagaacttgatctagttatcgctgtaaggcaaatcaattttgttccaataacgtcatttcagttaaaaacgtatcacacctcctctcaaatagtgtcacaactaaaaaaaaataaaaacggttttattgcaccaacagtttaataaaactacaaactattaaaaaatgttacgtttatagttcaagtatttgtcgttagattaccctagtgtcattataatcaacggtgcaccgaacataaacagtgtcacatatcgacttgtgcaaagcatttgcccatctaagatgtgtataaagcgtcgtttgtcgagttaaggcagtatatgtgattactttattcaaaaccatctgcgtatgtgctcaataaaagtgacacatttatcacttataatagtttttgaattaaaccctgaaaagttctagcacacattttaaatggcgttttctcaatattttgctttttgacttttgacactgtttgagcggaggtgcgatattagtttgtcgtgttacaccagcaaagctcttaaaacattcagtttggaaattttctcaggattttctatttttatttttcttgtaacttaaaaactatagaaaataggaagatttaataaatgcttaaaagataagcaacaacagtta

SEQ ID NO: 299 - DNA, 476 bp, Diabrotica virgifera
  Annotation=Similar to poly(A)-specific ribonuclease, PARN
  SmartBlast Evalue=3E-34; Info=Similar to poly(A)-specific ribonuclease, PARN n=1 Tax=Bombyx mori RepID=B9X256_BOMMO
caccaccaactggcaaagaagagatatgaagaaaatttgaaagaactagataattttcatggtttcagcaaacttctgaaagtgctgataaagtcagggaaactaataattggccataacttatgcttagactttttgcatacaattgacaagtttttgatgccattacccgaatcatatactgaatttaaaagagtgagccacacattattttctagagttctggataccaaatacatggcgagcagtgggctattcaaagacctgatccaatcaactgtactaaaacatttattggacacagtatctgaaagaccttttggacttccacaaattgctcccgagaaagagggtagagcctatgaagtaaacgatagtaaggaacatgaagcgggctatgacgctttcatcactggactttcttttataggaatgtggaaacatcttggtttacttgataatcgaagtgatcctaa

SEQ ID NO: 300 - DNA, 682 bp, Diabrotica virgifera
  Annotation=Coiled-coil-helix-coiled-coil-helix domain- containing protein, putative
  SmartBlast Evalue=7E-21; Info=Coiled-coil-helix-coiled-coil- helix domain-containing protein, putative n=1 Tax=Pediculus humanus corporis RepID=E0VT03_PEDHC
gcccggtgttcatgaccgacgtttgtggtggagtgatgtctaaacaaatttttgtatgtagttaaataaaaaaagttacaataatgggtgcttcgtcaagtgcaacaagaaagttaacagtagaaaacgatgatcctacaagcgtcattaaagtttcagaagaagttgtggatcgattaaaaggaagtcaagtggtaagaaatgaattcaaacaacaagctgttcctccaccagttcaagggggctcttttcccatatttataaatgaacctagtttaacctcctatcaacttcgacaggcaaatgtagctgaactgaagaaaaacgatgagtattggcaacagaggctgaaaaacttagaagagaaacataagaaaatgaatgatgtcttggaccaggagtatcaaaaagctttagaagaaatgtcatctggaaaattaggaagatacgcccaaaatatacctccatgcaaagatacagaacgtgctgtcatggaatgctacaagtgcaatcctcatgaaccaatgaagtgtgctagagtagttcaagccttccaggaatgcgtagacttgaaaagaaactgccttcttgctaatagaacaattgcaagtaactaaaggagtggtatgaagcttttagatttctttttagattgtttctctgtaaatataacttttgttta

SEQ ID NO: 301 - DNA, 568 bp, Diabrotica virgifera
  Annotation=Mitochondrial ribosomal protein, S23, putative
  SmartBlast Evalue=2E-32; Info=Mitochondrial ribosomal protein, S23, putative n=1 Tax=Aedes aegypti RepID=Q178C3_AEDAE
gaaatattaggaatttaaaactaaataaaaatacgataacttaatataaatttcagataaaatggctggaagtcgtttagaaaaaataggaacaatatatacaagaactactggattaattcgttcaggggccttaaggtgggaggatcggccgatatggtatgatatttacgaagcttttccaccaaaagaagaacctagatttgataaaccagttccaaacattaaattgaagactattttttataaagaagacaaaataagggctatatttcatagaaataacaaacagctgggcaccacaaacttatataacaataactacaagtccttgactcaaaaattcgtagatatttatcagaacctggaagctcacgcagaagattctgctacagaggaacagttgtataaggaagccatagaggtattacgaagggataaagaggtgaaaaaagttgatgaagaggagcctatttccttaagtcttgcttttaaggaggctagattggaacagaacaaaaaacaagagaagtcaaagttagatatagctaatatatttaaagagtag

SEQ ID NO: 302 - DNA, 874 bp, Diabrotica virgifera
  Annotation=RCC1 domain-containing protein 1
  SmartBlast Evalue=9E-34; Info=RCC1 domain-containing protein 1 n=1 Tax=Camponotus floridanus RepID=E2AS43_9HYME
gatgtttcaatggtcggttccagtgatgatttttaccttttcctgaaagatacaggagaggtactactaggagacctaaacaatttacaggaatccgtacaaacacattatgaaaaacattttcctgataaagctatcaaagatatagtttgtggatctaagattattgtcatttatggaacagacggtacagtgtgtaaagttattgacagtgttccggaggttcttaagtttaaatgtaataatatcgtcgatgttaagtgtggaaaagaacattgtttaatactggatgaaattgggaatgtttattcatttggtgtaggcagtcgtgggcagctaggtcatggaaaactgacagaagaaccagagccagtattaatagaagctttagctggcattaaaatcaagaaaatagcaacaggtggctggcattcgtgtgctattagcgaagatggtgtgttatatgcttggggttggaattgtaatgggcagataggattaggaaaaaccgaggaagaagatggatatgttgcagttatggctcaaccgcatgttgtagaattttctgatgaagacttgaatgctctttacgttgcttgtggagctcgacacactattgtttatacagatgataaacagttatacggctgcggatggaacaaataccatcagctaaaaacttgcgaggacaaaaacatcttcaaactgactcacctgcataacttcgaagatgatagcgtcctggacctccaatgtggaccatggagttcagccgctatatgcgaataaacagattcggtagacttagtcgacttaagttttgttttaaccaaattttattaagactgaaaagtatttaggattatagatctta

SEQ ID NO: 303 - DNA, 465 bp, Diabrotica virgifera
  Annotation=Equilibrative nucleoside transporter 1
  SmartBlast Evalue=3E-36; Info=Equilibrative nucleoside transporter 1 n=1 Tax=Harpegnathos saltator RepID=E2BT91_9HYME
acagccgtggtcggaggacaagccttgggtggcgtcttcgcagccgtaactcaaatagcctcattggccatcggagcctcatcctcgcacaccgccttagtttatttcgtcataggaaatatcaccatagctttaggtatagttctgtacatagttctatctagatctgtattttttacgtaccacacatctgaccagtctgtgataattaacgagttccaaagggaatcgatacaagaagttatatcgtacaaggagattttaaggaaaacgtggggttactgtttttgcgctttcttcgtctacgtcgtcacgatcgctgcttatccagcagttactgttcttgtggagtctgaaggaaaaggacacggaaacaggtggaatgatgtttattttgtaccgacgatagcgtacttattgtttagtatcggcgactattctggaagaattgttgcaggtagatta

SEQ ID NO: 304 - DNA, 866 bp, Diabrotica virgifera
  Annotation=Anamorsin homolog
  SmartBlast Evalue=3E-41; Info=Anamorsin homolog n=1 Tax=Aedes aegypti RepID=DRE2_AEDAE
agtgaatgtaaaaaatatttcgtattttcattttcgaagtttgtgccgtttgtgcatttctcaatacaaatcgtagtcacgtagcccacaataattttgtcctaaaatcgaaaacagagtaattaaataataaaatgggatcgttggaagatgtaacttcagcacatgaaattttaattttacatggacttgatgaaacggatgaattcaagagtctaaagaatagttttaagaagtcacgagtttgttcaaaggaagaaatttccaacttaaaggaagaatcagttcattctatatgttgcaactccgatgatgaattaattagttcagtcttcaaattgttggttccaggtgggcatgtcataattacacaaatttcaaacaaagaagagacaaaattgaatctaattatgaaagggtttatgaatgtcaaagaccatgacaattgtttagtagcaaacaaaccaagttttaagtctcgttcgtcagcccaaattaaacttcccccaaaatctaaccaagcagtgtggaaattggatgatgcagatgatgaaacaattgatccagatgatttgttagatgaggatgacttgcaaaaaccagattcggcttcattgagagtttgtggaactactgggaaacgaaaagcatgtaaagattgttcatgtggattagctgatgaactagcccaagaagtaaatggaaagacgataatagacacaaaggatgcacctaaatcatcatgtggtagttgttacctgggagatgcctttcgttgtgcttcttgcccatatttgggaatgccagcattcaagccaggggaaaaaattcaattagttggaaatcagctaagtgatgatatttaa

SEQ ID NO: 305 - DNA, 860 bp, Diabrotica virgifera
  Annotation=Transcription elongation factor B polypeptide 2
  SmartBlast Evalue=4E-39; Info=Transcription elongation factor B polypeptide 2 n=2 Tax=Aculeata RepID=E2BVI8_9HYME
ttatttaaataaatgacacattgtttgtcaaaccatcagcaagattaaaatttcagatgcatctacatattacaattatcaataatattttttaaatggtacaaatcaatattttacaaaaaaaaacaataatcctcgccatcatatatcactaaccaaaaaaattgtacaaaataacacacacatatcttcttacctgaagggcacttgaaaaaattacattttgaaaactagtcttcaaaagtgaatgacttcaaaagcactaaaaaataataatctctagtttaaaaagtttaacgatccaacagtggataagacggaaagaaaattaaatattgatcattcgatgtgtgaaaagaaaacaaagtaaaaaaaatgaggttatatacaaatagttcaagacgattgttcctggccgttgttttcttgtgatttcataacgtctggtagatctggaggggctgaatatggtattaaatcgagtggttcaaaatcgcctttaacatcttttatagcaagtccaactgtagcagggctctgggctttggcagttgtagaagtgagaccgtaatctgataatagcattgagtcttccataattgtattgtctttattaaatagttgctggttttgtggaggaaccttcaatataccttcaataatttttttgagttctaaaaccgtggtcgtatccttagcatcggtgaaaatcgttagcttttttcttcttatcatcaagaagacatccattttgtggagttggtttttgtatttattttgggacaaaatatgttttgtttattgcagtcattaatttatttaacctaaacaagtcaacgagatgatgggatataaatgcg

SEQ ID NO: 306 - DNA, 514 bp, Diabrotica virgifera
  Annotation=Biogenesis of lysosome-related organelles complex 1 subunit 1
  SmartBlast Evalue=4E-41; Info=Biogenesis of lysosome-related organelles complex 1 subunit 1 n=2 Tax=Aculeata RepID=E2BEJ7_ 9HYME
cacattgaacaagaatactgattatttttacataaaaatgttatcatctatggtaaaagaacatcaatcaaaacaggtattaaagaaagaactacaagaagcaaaaagaaaagaggcatgttcggctgcaaatgatttaacacaggcactggtagaccatttaaatgttggtgtagctcaagcttatctaaatcaaaaaaaaattggacgcggaagctaaacaattgcatatgagtgctacgaatttctccaaacagactcaacaatggttaaatttagttgaacaatttagtagtgctctcaaagaattaggtgatgtggaaaattgggcaaaggccattgaaggggatgttcgaaccattacaactgctttagaaattgtctatcaaggctctcaagaaaatagtcaatagttttaccttgtaaatatagctgtataagtatattataaatagctgttattatcagttgatcaaaaaatgtaaaaactcttgtgtatataaatgaatttaat

SEQ ID NO: 307 - DNA, 482 bp, Diabrotica virgifera
  Annotation=NADH dehydrogenase (Ubiquinone) 1 beta subcomplex, 7
  SmartBlast Evalue=7E-49; Info=NADH dehydrogenase (Ubiquinone) 1 beta subcomplex, 7 n=1 Tax=Tribolium castaneum RepID=D6X169_ TRICA
caacttttaatctaggagaaacgttcaaaattataatttatcctttttataaaatgggtcaatcatttggtcacacaatcaataatggttttgatttatatttccgcccagaaattacacctagtcctttcgaagatccaacatttgacccattagaaggattccaaaatggtagaaaagaaagagttatgattgccaccgaagaggaaatgagatctgccaaattgcctttggaagatcgagattactgtgcgcatttgttactcaaatttcgagcttgtagaaaagaaaactggccttttgtggtcaattgtcatcatgagaagcatgcatttttagactgtaaatatgaagattttgttatcaggatgaaagaatatgaacgtgaaagaagattgagagtattgcaacaaaagcaaaaagcagtagaagaataaaaatgtaatttgtacataagtagtaattttatttgtcaatatgtc

SEQ ID NO: 308 - DNA, 562 bp, Diabrotica virgifera
  Annotation=Phosphatidylinositol-4,5-bisphosphate 3-kinase catalytic subunit delta isoform
  SmartBlast Evalue=9E-38; Info=Phosphatidylinositol-4,5- bisphosphate 3-kinase catalytic subunit delta isoform n=1 Tax= Harpegnathos saltator RepID=E2C2K5_9HYME
cagcgcttggctccgcgttctacgaatacgaggtctttcctaagtactaacgtacctaacctaccccaaattgtttttgtctgggaaactgagggacacaaacgggaaaatggttccaattccgtctgaataccaatatgatttttgggataagacatctccagagtgtaccataacattaacttgtcttatgcctaatggaatcctaattttgttagataatacgaactacaatgcatctcttgctgaaatcaaggaggacctgtgggaggaagctgcaaagtttcctctctttggtaagcttcacgacatgtcaggatatatttttacttacatcaattctatggcagaaagagagaaacttaacgatgagtcaagaaggttatgtgacattagacctacagggtctatcctcatagtttccgaatgtggaggtgaaaagtcagatgataccctcaatatatctataggacatctgattggaaaacgtcttcaagaatttgactcccttaacagttcagaaatcaatgactttcgtttcaaaatgagacgaatgggggac

SEQ ID NO: 309 - DNA, 615 bp, Diabrotica virgifera
  Annotation=Alpha- and gamma-adaptin-binding protein p34
  SmartBlast Evalue=2E-23; Info=Alpha- and gamma-adaptin-binding protein p34 n=4 Tax=Murinae RepID=AAGAB_MOUSE
gctaactatgggctttggtttttttctttccttcattaataaattcgaccatgtatgagagtgtaaggcttcaataaccctatcgacaccaaatttctcagtaactatatcatcctcatggtctgacttttggattgtgggatacaactcaataaactcaaaccccatctttaagcaccattctaaagcttgactctttgttatattcgtattatctgtacaataatttgctaagagtaacttaacatctacattccatacatctccaaggaactcccacttttttagatcatccaggccagttttgctgttagaatccatgtggatgattagagcctcaatgcgactaaggaagtcttcatctttctctatttccgttgtttctattcctaaaaggtttacttgagcagtataatacttagtatcaatattccaggggtgttgtaaacaaccgggttggtcactactttcttggatatcgtgagtctttgatatcaatttaatcagcgattttggccttgtctggctgcaactcactattgctattcctggtattgaacccattttattatttgtgattaaaacattttaatctattcattgattatatatgga

SEQ ID NO: 310 - DNA, 783 bp, Diabrotica virgifera
  Annotation=Mediator of RNA polymerase II transcription subunit 28
  SmartBlast Evalue=5E-38; Info=Mediator of RNA polymerase II transcription subunit 28 n=1 Tax=Harpegnathos saltator RepID= E2BL12_9HYME
gccccatgaaaaaatataccttaatatcccaaaaatataaattaacgccgatctacctgcatttgttgtaactgttgttgctgcatctgttgcatctgctgttgtatttgcaactgttgttgctgttgttgtagctgttgctgctgtaattgttgttgcattgtagcaggtatatttgagatcatttggttgggcgtttggtttcctggtatacttggcaaaggtgaaggtggtattgagctagtacctggtgtagcagaactttgtgcaggactcttcgaatagctttgaatatcagctaataaattttgccacacagctattttttcataatgcctttttaacagttcctctttcctagctaactccagtctaagttcacttatatcttctttaacattcatttcaggtttgagggcagataaaaggaaccttttttgtagaaaaaatgcttccatttgcctagctaagtctataaaacgaagagtagtttgttctacttctactttgacttcgtctttgtctgaggtaggtagagcttcttctttggtgaggacgtttaaacaatgctgaaacgcttcttcaaattcgtccacaagatttccactgctatttgttggggtggccatcgccgatacaggaggcgaagcttctttcatcggagtcattgaataaattttgtgataatagaattccagtaaaatattagactcttgaatgaaacaaaataatcaatagacaacataaagagacgctgaaaatgatggagttgttgcaatgttg

SEQ ID NO: 311 - DNA, 830 bp, Diabrotica virgifera
  Annotation=#N/A
cagtttcaaaccaaacccattcatgagacggagacgctccaaatccctttcttccatcaattttggttcaacatgtgattgtgcatcgaaacaacaaagtgtaaagcatactacatcatttaaaaaagccaaacaaaaagatcctcagagatcctgtgttaaagtttgttgagtgttctcaaaagggaaaacactctaaaggacactcgtccaaaaagaaagacaaacagtttggtgaaacgtcaaagcctacagatgattttaagtccatcataaacggttgtgaactgttaagcatacgcaataatgattctaatttggacaggtactccgctcctagttttttaatagctcagtatcaaaataatactcagagatctgatagtacgagtcagaacattggtagctgctcacatcaagctaggatgaacgttaatcccccgtgtgatgtgacaatcgacgaacttgctagttactttgaaacatttgtacatatacccaaaaaaatgagttctatggctgagatgatgtatatttaacaacattataacatttgtggtttgatgtttaactgcttcgattctataatgttttaaatatttagctgttgtgatgagtaggtttaggttttggttttcaaggttttgattggatttgatagcacttaatattttctgacaagagctcagtgtatttgttatttaaatataattagaacgagtatgacgactacaacatcagatccctttcgaagataaaatataggtggatggacactgtgagcataaaattcatagttgcatgatatgtgtaacatttatacagtaatc

SEQ ID NO: 312 - DNA, 539 bp, Diabrotica virgifera
  Annotation=Ca2+/calmodulin-dependent protein kinase
  SmartBlast Evalue=8E-14; Info=Ca2+/calmodulin-dependent protein kinase n=1 Tax=Glossina morsitans morsitans RepID=D3TP01_GLOMM
acacttggcattgcacaaagtctttgtctttggatacaggtatgaacgtaacttccttgtcggcaacaacagactgtaaccaggtggttcctaagccagtaacattaactccagaaattttgacgggtagatctcctgaaggtattattggcaagggtaccagaggtttgtgttcaatgattaacaatcctccatttggatctattcgtttaacttgtccagtcagttctcttttttcttttataaaatgatttggaatatcggacggtttgcggaaacggcttaaaggtctaactttccttaaagctactgtcaatccaaggagagctaccgaatagcaagtaatctgtgccccccggttatctttctccatggcatttattatatcgtcaaaagatttcgtaattttctccattttaataagcaataatttatttcattaataaataaaatatcgcactttgtgttctctggaccttagataaaataaatctgtttcgattcaaaaattttaagtatttttggctctagtctcttat

SEQ ID NO: 313 - DNA, 1633 bp, Diabrotica virgifera
  Annotation=Mitogen-activated protein kinase kinase 1- interacting protein 1
  SmartBlast Evalue=1E-36; Info=Mitogen-activated protein kinase kinase 1-interacting protein 1 n=2 Tax=Formicidae RepID=E2AAM8_ 9HYME
aaaacaaaacatattttttgattaaaaaagaaataatggtcgaagaagcaaaaaaatacctccaagatattttgggaagagtcaatggtttgcattgtatattaataacagacagagacggtgtccgaatgttgaaagtttccaatgacaaaacccctgaacaagccaacaaaccaaattttatatcaacttttggcttagccatagatcaaggaagtaagctaggactagggaagaccactacattgatctgcacatattctcagtaccaagtagtccagatgaataagttgcctttaatagtaacattcatagccagtgatagttgcaatacaggacatattttagctttggagaaacaaattgatggtatagtgtctgatttagcgttagctgtgactgaatcctaattaagaaacaaatttattctatatcgtcagcttactgtgaaaaatgcatgtccaaaatacccgattttacaggagagacaaaaaccaactgtgtataacttgacttgaatacaacaaaattcacggttttagtaataaatttagttaatcaccaaatgaagtgtcgatctaacctaggcatattgacctgtttgcaataaaaatatttttattttataaacagcaaaaaagcagccatacatttgaacagtttggcctcacaagagaaaacttatgcagatatcatatggttgtcaaaattaacggacttattagaagaaaacagagtcatacctacgtagcttttggataatactaacaaatgccatcaaaagtctacaattaggacttacctaaatattttggactcacgcatttttcacagtaagccaactatatgtttgctttgaaaaagttaattttccaaacataaatttaatattatgaacttgtgtaagtttttctatattgtatattatttagtgtgtctgtacttttgtgtcaaaattaggtatttctagtaaattgctttctattaaacaaaaataatacaatttttatattgaaagcattagtggtagacttttattactattattttgtttcatctttctgtggcccccttttgtccatgttagactccctctcttcttgtaggcccccctttggccatgttatattcccccttcgtcctgtaggcctcagttatccatgttagactcccttgccttcttgaatgcatcacttgactgttacatacatccctctgtatctttacatgttaattttacagtattagtacaataatgaaattctaaataaaaacgggtcttgaggtctggtactatactccctgcgatctctacagggagtctacttattgcatactgctactttacatgctctatttttctatgtcattgtacctcttgtctccccccttttcaacaagccgttatgcaatcagatagtttaaactgttaataccctaatgttaacatcagatattaacaccctaatgccccttgttagacctgccatgttctatttttctatcagtgagcctcttcctcttttcaacaagctgtcatgcactcacctaccgacctagcttaggctgtttatgttaaggtgctacatgctaaggcccctttggttatccattccccaatccccagttctag

SEQ ID NO: 314 - DNA, 831 bp, Diabrotica virgifera
  Annotation=Vacuolar protein sorting-associated protein 37B
  SmartBlast Evalue=4E-23; Info=Vacuolar protein sorting- associated protein 37B n=1 Tax=Camponotus floridanus RepID= E2AEC2_9HYME
gtaatcttgtgtcatttttatatttaatttttacttttcagattaaattattttaaaaatgtcaatagaaattttacaggccgattgtaaacgagctgtaaaagatctagtgtctttaagcaacgatgaattagattcaattatcaacaatgacgagagaattcaggaaatcattacacagctagatcagtcttatttaaaagagattgaaaatgaaaaagaaaacatattggcaagtaacaactcaatggcagaattcaacctctccaaggaaccagaattagttgaaggcagggaaaaaatagaggaactgtcacaacagggagaagaattgacaaaagcagtggaagataaacttaaagaattgagggacaaaggtggtgatatgtccttagaaactgctttagccctgctacagacagcagccagtgaaatggaagaagaatctgataaatcatcaaaaaaatttctagatggtgaacttgaattggatgattttcttgacgacttcttagaaaaaagaaaaataatgcacttacgtctggtaaaagcagaaaaattatctaaaatcctacagagagatccaactttgaataaccctaattacattaatgcaccccctgttagcataaattctaattattttcctggtgttaacatacctggagataacccatctggacctatgcccccttatcccattgggcagccagcagttccttaccccactgggccattcaacatgccaatgccacctcccattaggaacaattattttcagaattattagtgccacatgttatatagaaatgaaagattttatatttacga

SEQ ID NO: 315 - DNA, 776 bp, Diabrotica virgifera
  Annotation=Tetratricopeptide repeat; Pfam: PF13414
  SmartBlast Evalue=4E-36; Info=Secreted protein n=2 Tax=Ixodes scapularis RepID=B7Q815_IXOSC
ttggtgtcactaagcatttgggttgccatatttatcaaatttggattattaatgaactgagacatgtctagattgcgatgatctgttggtgcagcagaatcgctattaccaaacagtttctcttctgcaagtttataattagcctcatacatctcattgccaggatcatgttttagagcttcggcataagctttacatgcttcttcatacctgtttaagttggaataagcaattccaaggcgtccatatgcctttccgtatgtaggatctagttttattgcttgttgacaatcatttattgcatctaagtgtttttctagtctactataggcagctgcacgattgcaataatatactgcattatttgggtttatattaattgcttttgtatattcagtcactgctgcactgtatgctaaatttttctatatgggtgtttccattgtttttattatatttcagcctctttaatctggtcttctgtaacttcagccctcctggttactggtatcaatgaaagtaaatccaattgattctttgatgcttcatccttaatatctgactgaatatcatatgctgtttcaaggcactgtatcgctacttccacagactcttttttttttcattcatatttccattaattagttcatcttgcaagaagttgaccacgtgagccataaaatgctttttcctattttctaaatccatttccactttattaatttgcaatacaatatacaattattttttaataatctaggtttatagtggaaatg

SEQ ID NO: 316 - DNA, 725 bp, Diabrotica virgifera
  Annotation=Putative sodium-coupled neutral amino acid transporter 10
  SmartBlast Evalue=1E-40; Info=Putative sodium-coupled neutral amino acid transporter 10 n=1 Tax=Camponotus floridanus RepID= E2AL68_9HYME
aagttggctttattttttcagttgcgtttagttttccactcgtcatctttccatgtagagctagtttgtattcatgcttgtataaggaaggatattctgtacacgaaggcagcataaattatattcctgaaggaaagttcaaaggtattacgattttaatagtgggtgtttcacttgttatgggaatccttattccgaatattgaattggtgttaggtttagtgggctcgaccataggagttatgatctgtgtattatttcctgtaatatgttttatttgcattactcagaagaacaccaatgaaaagattattgcgcaatttctacttatgattggagttttcgtaatggttgtaggaacatataaaaatttacaaactgtagataatttagaaccgattataatcacagtgaaaccaattgaattcgaccctgtaaaaatagaagacaatgttaataagctcccatttactgtgaagtcagagataaagcctgagttagtaacagttgagaataacgtaaaagaaatcagacacgaacctccacaacctattgaacccatagaagaagaacctaaaaaagatgaaaaacctagaagcgttgaagaaatggataaacctctaaagcagctagaaaccataaatcccgctgacaaaattgagatagtagctcctaaagccagtgtagtcaatgatactaaaaacgatcaagtagatatagaagcc

SEQ ID NO: 317 - DNA, 930 bp, Diabrotica virgifera
  Annotation=DDRGK domain-containing protein 1
  SmartBlast Evalue=1E-40; Info=DDRGK domain-containing protein 1 n=1 Tax=Culex quinquefasciatus RepID=DDRGK_CULQU
agtattgggtgttaaattgattagtacattgctattttcagctaattctgctatagagactctacctctttgcctaataaatttagcaactgcttccatctcctccggagatacataaatgaattttcctctatcatctactactccagttaatatatcatccttctgcaagtcttttatcctatcaatagctgcttgagttttaagcttgaaaagcgctgctaaatcttcaatcactacaaccttattggtctttatataattcacaaactcttgcaacaagttctggctatctccttcttccccttcctcaaacccttcttcctccacagaaaacgcttctttcatctttaaatattcttcatactctctcttctcctggtcttccttcgcctttctctgctcttcctccaatcttttttcttcagccttttccctttcatctgcctttcttctttcatcttctgcttgttcagcttttttctttttgtcagcccgtatttgttcctctacttttctggctgcctttttctcggctttagcttctaattttgctctctttttggctcccattttaccatcaatttcgacgtcattgatttcttcttcattgtctactccttcgtcgtcatcatctaactcttggtgtgcaacatttgctcttaaacgcactcctctgtttctagcaatctgagcccttcttccacctggacctgctgcctctcgagccctatttcctgcagctctaggtccattagcatcttttacttccttagtctgtttgagataaaacgttaatcctattataactgaaaataagaaaattgctattcctgctaatatcgtaatatccatggtggataaattaggtttttgtaactacgtaattttttctttttaaaaagtgctcagaaatagtaacttcaactt

SEQ ID NO: 318 - DNA, 815 bp, Diabrotica virgifera
  Annotation=Cactin
  SmartBlast Evalue=3E-46; Info=Cactin n=1 Tax=Tribolium castaneum RepID=D6WRR2_TRICA
atttggattattggaatgatataactgtaatagtggaagatgagttgcagaagcttaggaagctggaaaaacagaatgattttgatttaggtttgaatagaagagaaggtatacatcagtcagtagctggagatgttacttccgtatttaaaggtaaaacggctgtccagttagcagctttggaaaagacaaatatagagatacacgggatagaagtagcgataaaagcaaagaaaaacgtaagaaatcaaagaaaaagaaaaaagatccaggagcagttctgaggaatccagctcgaacagcgacagctctgataattcagtaaaattgctggaaaagctcacaaaagaaagaattagacttggagaagaaaggaagaagcaaaaagaactaatcaaagctactgaaacagcagaggagaagagaatgaggcggctcgtaaagaaggagaacaaagagagatccaggaaagagagaatgggctgggataacgagtatttacattatacaaacagtgacaatcctttcggggatggaaacttgttgtctacatttgtgtggtccaagaagttaaacaaagaaggattgaaaggtgttagtcaagaagaaatcgaagcaataaacaggatgaaacaagaagaaaacaaaagagaactggaaaaagtaaaaaagagacgtctagaaagagaattagaaagacagaagagggacgaagaaacccagatgctccaaagaagcaaggaagcagcacaatttgaagagtgggagaggcaagaagataagttccatctggaacaagcaagactgagatcaca

SEQ ID NO: 319 - DNA, 1107 bp, Diabrotica virgifera
  Annotation=Novel protein (Zgc:91844)
  SmartBlast Evalue=1E-19; Info=Novel protein (Zgc:91844) n=4 Tax= Euteleostomi RepID=Q6DBU2_DANRE
catatgcatatccactaaactttctttggaccttttactcttttttactattgcttcttgctctttatcccttcttttcatctcttttatttcagcctctttttgtaaatccacttcttttgtttctttttttgctttcttcttcgatcgatcttcaggagtatccgtccatgatgacctgtcagacatatctggtgcttccttagctctaaattgccgaggtcctaagccaaaatgcgtagctttagcagcaggtagctccaacatccattcctctcttgtaggttctttttcacccttgggatttaacatatcaattttcatttgtaaggctctttcttccaactcaatgtgagccttggaaccactgaaaccaactggaacaggaccatacacatcttcttcttctgattgtaactcagctacttgtgctagttgttgtcttaaatgatcaggtaaagatggaccaaaacattttgattctggtgtttcttttggtagatttttactttggagatttggaggtagtgcaggaccaattgatgtattattttgcaaaggtttctgtaagtgaggaggtaaacttggtcccaaagtctgaggtggacttacactttcttggctcttcatcaaatgaggaggtagagcaggtcctataactttggattcttcaatatctaattccttagttttttgtaaatgaggaggtagcattggtcctacaacttctgctatcttctcctgtggcttgggaggtaaagcaggtcctattgagatgtttttatgtaaatctaaaggtaatgatggtccaaaggattggttctcctcaacgatgctatcatatttttttacatcttgattgcttcgaactgagttcgtcttatatctaataccttcatcagaatttaccgaatctgaatctgatgtattatccatatctgtcaaatggtgttagaagaactgtgccccaaataattaaaaacatttactatgaaagtgaaatattgattattataatatcatatatacaattttgtacatatattctacatattatcatgtaaacattttgtttttattatttaatttcgtgtattttaaattttg

SEQ ID NO: 320 - DNA, 628 bp, Diabrotica virgifera
  Annotation=HIT zinc finger family protein
  SmartBlast Evalue=9E-32; Info=HIT zinc finger family protein n= 1 Tax=Culex quinquefasciatus RepID=B0W2F7_CULQU
attcaatattttgaatttttatgtttgattaatttgagttcaacatgtcttcatcaaaaattatcgaactggatgaaaccaacacatgcaaaatctgcgataatgctcttgcaaaatactcttgtcccaagtgtaagctattatattgttctttaaattgctatcaagccaattcacacttagaatgcagtgaaagtttttataaagacaatgtctttgaagaacttaatttagacaaagaaagcccaaaatctaaggagaagatgctagaaattttgaagcgatttcacgaacgaaatctactaccttcgtcggatgtagacgaatcatttagaggatattcgggattttctattgaggatattttaaattttgatcctggagaatccgatggtgggaaactcgactctgatgatgagatgttagatattggagaaagattgcaaggggttaatttagatgatgccgagaaagtatgggataaacttacagatagcgaaaaacaagatttcctagcttttttaaaatcagaagatgtttccaatttaataccttcctggcaaccttggtggatgttttataatcccaccatggttgaagaagttgaaaaaatggatgattataaaaa

SEQ ID NO: 321 - DNA, 560 bp, Diabrotica virgifera
  Annotation=Mediator of RNA polymerase II transcription subunit 7
  SmartBlast Evalue=4E-36; Info=Mediator of RNA polymerase II transcription subunit 7 n=3 Tax=Aculeata RepID=E2A954_9HYME
ggctggatttattagttaattgcccagactctcctcgaagagcagaaaaagtggaagatttaagtttgttatttattcatattcaccaccttctgaatgagttcaggcctcaccaagctagagaaactttgagagttatgatggaattacagaaaaggcaaaggatagaaactgcgaacaggtttcaaaaacatctggacagagtaatggatatcttgcaacaagctatccaaaatctcccagaacctatggatttagactcaaaaatcatgatagacacagattttttgatgcatagtgaaaacagtgataactcagaaacctcacaagatccgtgctatattttggacagggttatgtgtaatatagtagataatatgcaataaggtttatatcttggtactattattatattatttatttacatagcttctgttttaagcagctatgcttttaataatggggttttagttttaaatataggtattatgatattggtaaaatatttcttagtaaattttccatttgtattaagttcatagaatacagcaaattatttc

SEQ ID NO: 322 - DNA, 472 bp, Diabrotica virgifera
  Annotation=Mitochondrial import inner membrane translocase subunit TIM14
  SmartBlast Evalue=1E-37; Info=Mitochondrial import inner membrane translocase subunit TIM14 n=5 Tax=melanogaster subgroup RepID=TIM14_DROME
gtaattttattgaaatatgtaacttttgaaaaattctggtgaaaaatgaatggaataatattagcaggacttggtttggcagccgttggatttgctggtcgatatgcacttagacaaatgcccaatgctgctaaaacctttaatgaagcaatgaaaaacctcccaaagttcgattctgcctcagttgccaactctaaatactacaaaggagggttcgatcaaaagatgaataggagagaagcagctttaattctaggtgttacccccagtgcaaataaaactaaagttaaggatgcctttaagaaagtgatggcggtaaatcatccagatagaggagggtctccgtatatagcatcaaaaatcaatgaagccaaagactttttagaaaaacactcaaggaattaaaatagtttattaaattcaaattgtatatagataaaaagcttaataaagattttacatagaatagact

SEQ ID NO: 323 - DNA, 679 bp, Diabrotica virgifera
  Annotation=Transmembrane protein, putative
  SmartBlast Evalue=5E-25; Info=Transmembrane protein, putative n= 1 Tax=Ixodes scapularis RepID=B7QEK6_IXOSC
acacttgttgcttgcttttaaatattcgaaatttgttggtgccccaacaatttccattaaaaatgatggattccaaataacacgtaagacattcatgtacgaaatttgatacatggcacagttcataatttaatataaccaaatcttgttatctcttttgtactgtactacatagttgcatatttatttttattctttaaaattaatagcaattaacaaatagtgatagccgagtttaacaatatgaaaatgaaaccagactatgcagaaatggtggcagctgttgcatttggtgtactttcagccatttttgtcagtgcatttgtaattttaatagtaatttgcagaagacataaaatgttttacaaaacaattttgtttgaggatgttgctgtcaggcctgaaaaacatctaattgattctgagcctccagaactagagttgggtgaagtaagtgcagatgttgaagatctaactgatgagcaatggattgatgatgctacaggactgataccacattgccttgcaattttaaaaacttgtagatctctcacagaaagattgactgctctagctatgagttctactcctgcttctggagattttagacagatcgttgagagtgcaaggagaatttcgagcagggttgatgatatggtaagaagtatgtatcctcctt

SEQ ID NO: 324 - DNA, 664 bp, Diabrotica virgifera
  Annotation=Mitochondrial ribosomal protein, L46, putative
  SmartBlast Evalue=2E-46; Info=Mitochondrial ribosomal protein, L46, putative n=1 Tax=Aedes aegypti RepID=Q16UP8_AEDAE
gaaatcatacaaaagataacctcttttattttaggattttaaaatgatcaaaaaatgttttcagttattacagaatcaaaataatataaagcagataataagaacaacacgaactcaacccgtttcaagtgaaaaatgggatttatttgctgcagtatgcctagaacgaaaaccagtaataggtccaccactaaatgatttacaaaaggactataaacaattaatgagtgatatagaatttgaaagaagtttaaaatctaattttgaactaaggcatgaaactgatgttaagaatttagaaatattgaagaaaggtggagaaatagcagacatagatgttaatctaaaacagactgcccaagatttaaaagatatgtggacagcagaagccgcacagtttaagtttgctgatacagtgacagaggcagataagaaaaatgaccaaaaatctttaaatcgaaggttggataaacatttaatatatgttttaaatcagaaagttggcgataagaaattctatctattaccacaaggtattaggcaagatggagaaactttaaggcagagtgctgaaagaattcttaaagaaagtataggaccagatgtgaaagctcaaatttacagcaatgctccatgtggattttataaatacaagtatccagct

SEQ ID NO: 325 - DNA, 495 bp, Diabrotica virgifera
  Annotation=Prefoldin subunit 1
  SmartBlast Evalue=2E-28; Info=Prefoldin subunit 1 n=1 Tax= Camponotus floridanus RepID=E2B0I7_9HYME
atccatttttggttaagatttaaaattttgaaaataatctgacaaaatggctaaagtcgacatggaattaaaaaaggcttttacggaattgcaagaaaaacaaatagaaacccaacagaagttgagaatagcagacatccaaatagacaatttgaaaagaaataaacagcatgcttcaattacagaaagagaaatcagcacattggatacaggcaccaagacatatgaatcagtgggcagaatgtttcttttaacgcctatcgataaggtgctggtgaacttaaaaacaaagcagactacagcagaggagaaaataaaggttatagacagcaacaaaacttatttagagaactccctgaaagaggccacaaatagcttaagggaactggttcagaccaaaaaggaatcatgaatgttttgctagttagatatgatatttattgatacatttgtatgtcacacgtttttcagatcttaataaaaaaactttaattt

SEQ ID NO: 326 - DNA, 452 bp, Diabrotica virgifera
  Annotation=F-box only protein, putative
  SmartBlast Evalue=3E-34; Info=F-box only protein, putative n=1 Tax=Pediculus humanus corporis RepID=E0W101_PEDHC
tatttaatatcctttctattttggtagcgtgctggtgccacagcacttgggatcccaaggttcctccccaacaggcatcccgttcggcagtcctcaaggctctcagattggtgagcaattgtcttaaacctctaggattatgctggctggtagtggcatgactagcgacctcctccaacatagcaagaaggactttttgggaacacccagagagagctgtcatctgttggccgatcagtaattccaatagagcacaaatataattaaatctacggacgtctctaacggcacttctaaaatctaaccgtttcactgcttcgtctaattcgttaaaacccgcaatttctttagtacattttattgtaatgtgacaatgaggttggatggcagtgtctgaatcactttcttcttccgagctatcatttctggacaccttttgcagggccttgcag

SEQ ID NO: 327 - DNA, 470 bp, Diabrotica virgifera
  Annotation=Paraflagellar rod protein
  SmartBlast Evalue=2E-16; Info=Paraflagellar rod protein n=1 Tax= Culex quinquefasciatus RepID=B0WRL8_CULQU
ctgctttttccaattatctgtggcttgtttttcttttttgtaattctctatctccaccttcaatgtgctgacatgttcttctttgtccgctaattgttgtttatcacgggagatgtcatttgcggcagtgttcagctgtatttgtagatttttgcattccttgcgcgatttctccaagtcgtcttctagtttatcgcattgattttgtaggttctgtatggtctttatgtttatcatcgatttcttttgtgcttcttcctgttccgattgattttgtgctatggtttgggtaagttctctaactttacccttaagttttactgccaaatttctcaactttccatacttctcctcccaagatccctccagatccttcagcctattcacctcttcagtcctggaaatggttgaagtggacaaagtatcattatcagcataactattctccatattagcattcaacctatccc

SEQ ID NO: 328 - DNA, 767 bp, Diabrotica virgifera
  Annotation=Coiled-coil domain-containing protein 95
  SmartBlast Evalue=2E-22; Info=Coiled-coil domain-containing protein 95 n=2 Tax=Formicidae RepID=E2BWW1_9HYME
gtcaatgtcaaacgcgttgtgtacaattttgattattaataatagtttgtaagaatttttataaaattaaaaaaatgtaattgaacattgacaaataaaactaaaatgttggaagggtggtattgtcgatcgatagcagatgaggcagcagccgcagaagaagaggaaagaattttagaggaatcaaaatttaaaaaagagtacaaatatctaaaaagaaaatttcaaaatttagtttttgaaaatgaatcatttcaaaaagccctcagagtggcacagaagaggttgctggtagtttctagagatagagcttttttactagaccgtttgttgatgcatgaaaaagctgaaaacagtacatcggaatctgacgacacagaatcatctgatgatggagaaattgcaaaaccggaacccataaaaaagcaccgtagagatattagttctcattcaaatatgcatcatgtgaattcttctggaaaagtaatgtccatagcaaaaagaaaagacctcctgcacctagacctcccaaacatcaaatacctcagacaatgcaacttcaaatgcctccaagtagtagtgccttatctgatggtcatatgactcctgaagaagttgaaagacatttacaagctcaaagtttcatggaatttcttcccgagagggcacctccaacagttcccacagaaatgtttagtaatgagccatcattagatagcgaatctaatgatatcggggaacttgagacatcaccaagcaatatgggc

SEQ ID NO: 329 - DNA, 634 bp, Diabrotica virgifera
  Annotation=Fez1
  SmartBlast Evalue=3E-35; Info=Fez1 n=1 Tax=Bombyx mori RepID= B3GQX4_BOMMO
gcccgcttttgtccatctccagttctacagttaaattttcaatttcagcttccagcgctctggttcttctaaacatttggacgtagttcatttgtagctgtcgctggtatctgaggaccttttctttttcttgtacccagattcttctttcattttcaaattgtttggatttagccgatatttcctttttaagagtttctatttcattgacgctttcttcttctgcatcaatatctattttcttgatttcaatatggtcgttactaccatcctcattgatataatgtgctttatttcttccaggttccacatgggaataatcttttaagctcatatctgagagttcttctctcagttctttaatttctgcctttaatttttctgtttcttcataatttggatgaattgtcatggttttttcgtaaattggtgatggtaaggcttttagttgtactatttgccttttgagctcctcaatttcttcatctttggaatttgttattgaatgtaaattttctagttcttggtttttttgttccagttgatgtcgaagatcacgttggtctgttcggaataggattaactcctggtttttattagtttgatcaatctgaagatctttgagttgactttt

SEQ ID NO: 330 - DNA, 513 bp, Diabrotica virgifera
  Annotation=NADH ubiquinone oxidoreductase subunit, putative
  SmartBlast Evalue=7E-34; Info=NADH ubiquinone oxidoreductase subunit, putative n=1 Tax=Ixodes scapularis RepID=B7P5E4_IXOSC
ctgagttatgtcataggaaaatcatttcaatcaaaataatggtaaaaatgtctcaagtaaaattattggcccagctttcagagagaattcttctgagacaaagcattgctacaccagctgtgagatgtatgtcagattgggtacctaaggaaaaagaaacacacactggacagaaatgggcttctgatgactacagattatctagatttgtagacaggccaaaacatgtcaatccaaacttcgcaatcaatcttgttaatgaagttcccccaaaggcatgtaaagatcgtgtagtatggtgtgatggaggtagtggccccgaaggtcatccaaaagtatacatcaacttggacaaacccggcaatcatgcctgtggatattgtggattgaggttttatagggaagaacaccatcattaattattgcatcgcaaagtttttttatttagaactaaattaatagatatataaaaaatgtattgaagaaaacaaataaaagtatgtgaatgtgttt

SEQ ID NO: 331 - DNA, 992 bp, Diabrotica virgifera
  Annotation=Protein C10
  SmartBlast Evalue=3E-32; Info=Protein C10 n=1 Tax=Camponotus floridanus RepID=E2AIQ9_9HYME
gtgaagatggtgtgaattgtgagtaaacataacataaacattttaccaaattttactttactcctactcctaagtcctatgcaggacgctatttattaaaaactggaaacataaactaacttataatacagtttaatattttgtaaataacctcggattcttaaaatgtctaaatccgaaacaataccaaccttaacagtagatatcgctaaagacattttgaacaaaactctagaagaattgcaaattccagaaaatgttcagaaattggacgaggctagagacaatgttggcaacgaaatgttaaaaatgatgcaatttttatttccgattgtaatgcagatccaaatggaaataataaaacagtttggatatccagatggaagggaaggtatcatcaaattttcccaaatgttgagggctctagaacgagaagattcagaaatagccaggttgaatggtttagttaagtcgtattatcttcctcctgtgactgttcatacaaccaatgaatcgccagcagaagaaagagttagcagtagttagataggtatagacaattttatttatacaattttatgttataaaacaattaggtattatatttggtcgtacatattgcaccccaactaaaaaaattaaaaatctgtttttttgacctaacacgttcctttaggtgttgccttcattgtggaatactgtcattgtcatataatttagttatcttagaagccacaaagtgcgcttatgtcgttattactatttacagttttggctcttacagcattaggtcaataattaaaaataaaataaataaataaataaaataaaataattaaaaataaatactagccttagcgagagcactcaccaatgtggcaatgaaatgacgtgcaagtggtttggtgcccagtgcaggtagaattgctaaacctgtataaacataataatatgtaatacctttcgatatgtgcaactacatatgaagagta

SEQ ID NO: 332 - DNA, 476 bp, Diabrotica virgifera
  Annotation=Transmembrane protein 32
  SmartBlast Evalue=2E-31; Info=Transmembrane protein 32 n=2 Tax= Formicidae RepID=E2BSL2_9HYME
aacaaatagaatgaggttagcaaaaaagactatcctgtaattttatttttaagctcaaaatctaactaaacataaaaatgtctgcttcgtttattcatagaataatcctgtctgtaggattcctatcattgtttcattctgcatattcagctgctcaacatcgatcatatcttcgtttgaatgacttagattttacacatttacctttagatatctttattcaagctttggttagcctctttgtcatcatgtatggagttctgagcatcgctggagagtttaaggagatcaaagcctcagctgaattggaaaacaggtcctgggaaacttttaggaacattccttccttctataccttcactcatagaggtggcaaagcttcaccagtattaaccaaagctaggttagaagaaattgagtagtagggaataggatttttggatttatttggactttgtagagattggtatgaaaag

SEQ ID NO: 333 - DNA, 671 bp, Diabrotica virgifera
  Annotation=Cell division cycle protein 123 homolog
  SmartBlast Evalue=2E-25; Info=Cell division cycle protein 123 homolog n=3 Tax=Xenopus RepID=CD123_XENLA
caaattttcaaatgttagaaatccaagatttgcgtgatttttcaattcaaaattggtacgacaagcttaaagatgtaactataaaaacaattatactagagctacctgagcaactcttgaagaaaattcaaaatgaagaaattcaagactctgaagaagaaaacgtttgtgaccaaagagaggaagaactacctgaaaaatttattcaagattttaaaaatgcaataaacacgcttgaaaataacgcctttgttagaaataactggcatgcaccagtcgacgctagagtgtttagttttggtaatgctttaaaagtagtaaatctggatgatgtaataacttattttatgagttcaagcaaaattcaggaagatttttctgtcgccaaaaacattccattctgtatagctttacgcaaatggataagcatccatccagcagctgaattcagatgcattgtcattaataacattctacgaggaatcaccccacgagactggccaactttttatgcgcatttcaaggaagaagggccgcagattattgaagaactaacacagttttacaatgaaaatgtcaagcttaaatttccgaaggaaaattatatttttgacgttgtttttcagtacccagaaaaaccgtacttgctggacttagaacctttaaactcc

SEQ ID NO: 334 - DNA, 1066 bp, Diabrotica virgifera
  Annotation=Novel protein
tgaagtcagggaagcgcattagttagagtgagtttggcaacaacgctagacccgctcttcgtaattattatcgtattctctagtcaatttttttgaaataattagtgactaaaaaactgaaccaaaggaattaatacagtgctgtgaagtgtggctggtggcaataaggtgttaaaaaactataaagtgattgtgactgtttttaacggcctcaaaatagctattttcggatttacaaaacggagccccgatacaaaaatggtgggcagtaacggcacaatgattgcaattcgtcttgttcgcagcaaactcagaaagagggaagaacacagcaacagcgttcatcccaccgatgtggtcctgcaaactaccccgaatgcaactcaactcaaccaccagaatacatcaccccatattctccaatcggacttgacctaccgaggacagtttctatggacgcaacctccaccacctgcgaatcagtacccgtacaatcacaatcaggatacgcttgtacaaaattctggggaccgtccaggattcgtccgaggattcaggaaaaaccttggaggaaaatggagacgtcttgtgaaaaggaagccttcccaggaagtatacaccattccagctgagttgaagcctcaactcaagcaaatttacgtttattagccttaatacaaaccgattggctgtcgaatagtcaattggatccaggccctacgaatgcggagcccttccttaatgagactgattttttaaactaatattactcctcgcgaataagaagagtaaccttagtttatgcgatgtaaatatttgactataggttgtaatacttacgccatacattatgtagaattataaattttacaagagtagaacaacttccgattatccggaagatatgttaatacttttattagtttaactccaaaaacgctttttgtagaaaatacttttatacgagtagatagaaggctacttgctccacacgttggccaaaaagcttcatgctgataaaatagataatgccattcaaaggtttttgtaaataaactgactacat

SEQ ID NO: 335 - DNA, 952 bp, Diabrotica virgifera
  Annotation=Coiled-coil domain-containing protein 124
  SmartBlast Evalue=7E-31; Info=Coiled-coil domain-containing protein 124 n=1 Tax=Xenopus (Silurana) tropicalis RepID=CC124_ XENTR
gtggaagtggaagtggacagttccgctacaggttaatgttaaaattaaatcaatatattttttatcaaaaattgtattcatagaaaaattaaatatgccaaaaaagtttgccactgaaaacaccaaagctgttgctgctagggaaagaaaaaacaagctaaggatgaagtctccgcgaaaaagcagaaagaagtagatgatttatattgggcagataatgacaaacagttacaaaagaaacaacaaaaaaaggaggcagaagaaaagaaaaaacaagaagccttgaggaagaaagctgaaacaaaagaattattagaaaaagaacaaagtgaaatcgttaagaaaacatctaaaacctgcacctccagtgaaagtgacaagagctcagatatctgccaaggcagctgcacctaaagtagaaaaagaagagaagaaagtggaaactcatctggatgctccattgattgaaaatattaataggctccaagtagaaggagaagaagctagaactattgatgaagctatttcaatactaggtaataatgatgaacttgacaaacatccagaaaaacgtatgaaagctgcatatactgcctatgaagaaagaagacttaaagaactaaaagaagaaaacccaactctacgtttatctcaactgaaacaaatgatcttcaaggaatggcaaaaatcaccagagaatcctcttaaccaatagtttacttattttgttattagctgttatcaacagaagtgttcaaattcagataaaaattggatacatacaatacctgtgtggatgtactacatcattgatgaagacttatgatagaattatgaattattaataagaatcttcaattgccccagaaacacactttaaaaatactgataactccatatatgttattatacttcaaagtttgtcacggtattcttaaattttcaataaccc

SEQ ID NO: 336 - DNA, 620 bp, Diabrotica virgifera
  Annotation=Ubinuclein
  SmartBlast Evalue=3E-30; Info=Ubinuclein n=1 Tax=Harpegnathos saltator RepID=E2BJH0_9HYME
gaggtctccaaaattctttttcggtttttgggtgtctgcttttcttcaccttcgctctcagacgacgaggaagcatcaggtgacgagggatcggaagaggaagcgttcgaactggcctcatcatcagtcttgaatacaagcgcaccgcaattcacgtagaaacctccgtggagcgtcgtaacgttctgcggtatgatctcgtcgtaaccgtcggtgttatctatgaaaggatcggactcgtcgtagcccatacctatatccgcgtaatcgtcctttcttccttttcgcttcttcttcgtcactccggagccatattttgcttccatttcttgcgcaattcttctgacatcgtcatcattttcgccaaacggatccaaaccattttcaacacaattggaggaatctttcacgggttttgattttttctttacagcagcagctagctcgtccttatagttaaactcagggtactcgtcttcattggattcgggtaaaataagggtgattcgcgtagttttggtcactttttttatcactttatcactcactttttgcgtttcgagtgtattcaggacgacacgtttgatttctgacatatttcattacaaattttcactaaa

SEQ ID NO: 337 - DNA, 694 bp, Diabrotica virgifera
  Annotation=WD40 domain containing protein; Pfam: PF00400
caaacagtaggtgtgttgtgtgttcaccgttttcgtagttctctggtgtctgtatcgagggaatccggtcttttaagctttaaagaaaatgttagatcaagttcaagaacctaatgccttcattagaaaaagaactacattacctaatgcacctctggaaccccgaaatcatttttcaaaaacaccagtgatatatgatcatttattttttgtgaattttaataaagcaggacattccatacttggtgcttctgcgataaccgacagtttctgggaaggtactctactttattttaaagatgaagatcaattagaaaattttgattatcatggatcttatgtatatggtaccacatcagatggaaaatttatagatgatagaacaatagctttagcagaggattcaggacatataaatatactttccattgatgaagacgctacacttagaactacaaattatttttggctatctgaaagagtaccagaaataggcgtatgggaaaattctggtaaaatattaggttgtgctggaagaacagtgtatatttatgatgctaattcaactaacggaaagcctatagaaagatatgattcttaccactgtgatacagtttcaagcgttgatactttaaaagacaatacaaatgtatttttgtcaggaggaagggacagaatggcttgcatatgggac

SEQ ID NO: 338 - DNA, 491 bp, Diabrotica virgifera
  Annotation=Tat binding protein 1(TBP-1); Pfam: PF00539
tgactcaaattacttactgtgggataaaaaaatcggtgcatttaaaattaagatagacctaaccttaaaatcgacaacgtgacgtcactaatatggcgtattcgttcttggagggaggaaggaggacagataatcgttttaggcagttgtgttaatagtgggagctatttccaaattggctaccgcttgtaaacgggcagcattggcgttgcaatctgctggtgtgactaatggcattgcagatgcactttgaaaattgatttcttctaaatctcgttgcagtttggataggggtgcgcattgttgaactacggtttgaatactgtgtaagacctctaaggcgtgatcgattgcatcgtattgtttcttagattcgtttacagcttcttttaaactctctgtcagaacttgcctactggccagaaattcctgcgttaattcattcagatgtttctctttctcgctcaactgttccttaagtattggtatct

SEQ ID NO: 339 - DNA, 585 bp, Diabrotica virgifera
  Annotation=GPI-anchored wall transfer protein 1
  SmartBlast Evalue=1E-20; Info=GPI-anchored wall transfer protein 1 n=1 Tax=Culex quinquefasciatus RepID=B0WBZ2_CULQU
tagtgtgcggactacaagaattcgtctttgaagattttaaaagagacaactttgtcaaggctaataaagaaggactggtctcttccattggcttcatctctttgtatctctattccgttcattttggttatgtactagacttaaaaaataaaaaccaaaaattctctagcgtgtttaaaaaatttgtgatagctattttactattcctaacgttatctgtggcgtttcaacaaacttttggaatatcgagacgggtagctaatgcagcttacgtcttttggattctgtttataggtatctttatgacgggattgttttacatacttcaaaccatccaaatcgccatttttggaccgactagggtagtacttgtgtcttatattttcgaagctgtcaatcataatggtttagtattttttctaatcgctaatgtgctgactggcgttattaacatgtccatgaatactaggaaagttgatactattcccgccttattaattgttatgggttatatgactgtcaactgtctagttgtggcagttttgtattccagaggatttaaattgaaactttgacaggaaccgc

SEQ ID NO: 340 - DNA, 716 bp, Diabrotica virgifera
  Annotation=HCaRG protein; Pfam: PF07258
aaaaagataaaaaataatatttttgttgatttttttaaattgtaatggttgaatctggtcttcatcctcttttgaaaatatcaaatccggatgatattaagaagtttttacatgaatgcatagatgatttgataagaaaacgtgacataagttttgataattataacagtggacctatagaatggactaaagatgactttgagaagacaaaacgatgtgttcaatcattctacaaacaatgtgtgatagaaaataaattccagctaaattctcaaaatttggaagaaaacattcatgaagctttaaagagttgctatggtataagaaaaaaagatatatttcagcatttagctaagtcttatattctaaaaaatggacataacttaatagaaaatatagactggaagttgaaatggatattagggtcctcagatttaactgtgataaaagaaccttatcttcagattgacttaaatggtattgaactctgtactggagagataaaaactacttgtctttcatttgaagcaaatttggaacaagtggatcaacttatcaaagaattggcagacatcaaggcagagttaaatgcaaaataaattattgttaaacattttaaaacgtattggtggccaatatttgtaaaaagagattatattctttttcttttatttatgctttattattattgtaatatgtcagttacatacattatt

SEQ ID NO: 341 - DNA, 1082 bp, Diabrotica virgifera
  Annotation=Mannose-6-phosphate receptor domain-containing protein
  SmartBlast Evalue=3E-12; Info=Mannose-6-phosphate receptor domain-containing protein n=1 Tax=Dictyostelium discoideum RepID=Q54XB6_DICDI
cctctgttcctgttgttgatatttctgtatcagtgatttatcattttgtttttgtaaagacaatgtaagaaaatgattaacggtagcaatagttttttcttattttttagcacagtagtgtttttatgtagctctaatgccgatacgtgtatcaatcacgatccgtgcctttgtcgaatcaatgaaaacgataaaataaacatatcagcactctcagaggatattaaggccccaaaatatttgagcgacaccgatggaaacttaacttacacatttttaggttgtaaagatgagatctttccgacagatgacaaaacacaacaatataagggaactttaatattgaccaaccgcacttgggactttaataaaaccaaaaacatttatgacgttataggaagttctgctttggcccgttttagtaaagatgatgatggatatatgctgacatatgccaatggctctgaacctcaagctataataacgcttctttgcaatagttataaagaaccatatcttaagatcactgatctacaaaaactgagtctagtcttgtcgtctcccaagctgtgcatacaaaccgaagaacatggaatgagtggcggttcagtttttctgttaattttctttatagttgctggcgtttactttgtgggtggagctgccctaatgtacttcattagaggtgctcgaggagtagaaatgatccctaatattgatttctggagaaatctgccaggattgatcaaggacggattgatatttttgctctcaggttgtaagcctaattttgtaacaacggcagaaacctacgatagaatataattagtgtaattatcggtgtaaggcttgactgaatcgatcgaatgttgttatatttttgttaatgaacacaaatgaatggttgagtaactcagttaaatatattgtagcttatccttttttgcacagtggtacacttttttatgcagaatatatatttcagaagtttctactccagcgttttcgtaagaatgtttaccgactaaaacgttttgatattcgatgtttataaaatcgcgtgatactcagattgcctgact

SEQ ID NO: 342 - DNA, 651 bp, Diabrotica virgifera
  Annotation=Novel protein
  SmartBlast Evalue=1E-20; Info=Novel protein n=2 Tax=Xenopus (Silurana) tropicalis RepID=Q28DQ3_XENTR
gccttgctgtattgctaatatattttctatgtctttgagcttctcataaaactttgattcatttacaaaaatttcccaattcatagcatttaagaaatccttttccagtcgaaccaatttttttaatagaaatatctccagatgcagcccattcatctacaaaaacatcatctccttctccatcatcaaataagaatttacaagaaaccatcaacgatacaagaaacaaatccgaaggtgcaactttttccaggtactgtgcattacatgttttcagtctttccaaataaagaagggctaacactagagagcatggggctacgcaggcgtttcttgagatttgtgcagctttgtaacagtgtagtctctccaaagatttgcctcgttttgcttcggaaaatatttcggcagccagttctgtaacgggtagacttagacaatcagttttgggaagttttccataataaagggtcttcgttattcttgacaaatatttctttcgatctccaaacatgtagggcatatccccacaatctttagatattttagacatgttaaaacactattattatgccaaatgttatctaccgcatttaaactgagcaattctgactgatacgtttgcaaatataaataatttgcaaagtgtag

SEQ ID NO: 343 - DNA, 533 bp, Diabrotica virgifera
  Annotation=Ribonuclease H2 subunit C
  SmartBlast Evalue=1E-27; Info=Ribonuclease H2 subunit C n=1 Tax= Camponotus floridanus RepID=E1ZVE6_9HYME
aatatgtatataatacactaactccttatttttgtgttggtaacttgttgtgtaagtatctgtagtaaaaggcacattttcttttgatctatgatggaagaaaaggaatttttggaaaattcagtgttattcttctagtatgggactgtgaagtgcttccgctatgtcaatccaatctagagcttggactatggtatcgttcttgcttggctgtttatcccaattccaatgtgtcagctgtgaaaacatattagtaacatataattttctatcgcatttctcagtctcgggccgaatactttcatgtaaaacaagtccaaagtatccatcaggtaagtttacgtgttttccttttagaggatatcctctaaacgaagaggttaattgttcgttttcatcagctttgatataattattaaaaaaattgttaactttagcgtcacagtcggcatggactttaaaaggtacactttgaatattacttgttcgatttttacaatctaaattgtttttcccgctgtgtatatgaatcg

SEQ ID NO: 344 - DNA, 410 bp, Diabrotica virgifera
  Annotation=Pre-mRNA splicing factor SF3B 10 kDa subunit, putative
  SmartBlast Evalue=2E-39; Info=Pre-mRNA splicing factor SF3B 10 kDa subunit, putative n=2 Tax=Ixodes scapularis RepID=B7QIF0_ IXOSC
aaaaatagctgaaaacaaggaaggaagcgaatcaaaataaaaacatttaattgtaaagactctccgaacaattatttgacaataaatcgcgtaatatgggagatcgatataatatccacagtcaattagaacatctgcagtcaaaatatattggtactggtcatgcagataccaccaaatatgaatggttggtaaatcaacaccgggatagtttttccagctatttgggtcatccagatttaatcaattacattgccgtttgtgaaaatgaagcgaaagctcgtgttaagtttaatttaatggagaagatgctgcaaccctgtggaccacccccagataaacctgaggattaaactataattacatttatttgtatttttcaacttttaacaattaaatactttggtaca

SEQ ID NO: 345 - DNA, 668 bp, Diabrotica virgifera
  Annotation=Motile sperm domain-containing protein 1
  SmartBlast Evalue=5E-40; Info=Motile sperm domain-containing protein 1 n=1 Tax=Camponotus floridanus RepID=E2AL36_9HYME
ctgattgacgtcaataccagcatttataaatttgttaaacaatgagttggtcagcataagctccaaagtgttgtagcaatacagaatgagtttaaatatccaaaaaattccagtgttcgtgtttcctaattctttaaaattttatttaagtactaaatctacacacaaacaattgttgactctgtacaatccatatgacttcccagtgcgatttaaagtgctttctacttctccaaacaagtatgcagtgatagatccagaaggaagtataggacctcaaatgttagttgatattgtgattcgacatacagcacctatcatatctaattgtaatgttgtggataaattcaggatatctatgcaggatcatgctaccaagcagctccttggtaaaagagatattgaagccatgctaatgcctggtgaaagagacaacatttccaatgatggtgactttcaaaatttaccccattctgacagaagtacaacagatgaacaaagaatctatatgacaaataggacactgccagcgataaattcgacaaactacattttgtcgatagtgataggattagtttgtgtgataactatgctgttaccaactcaagaagaaacgccgaagccgtctagtattcccgctcattttcatattagcgtcaattttaagt

SEQ ID NO: 346 - DNA, 665 bp, Diabrotica virgifera
  Annotation=UPF0586 protein C1778.07
  SmartBlast Evalue=3E-14; Info=UPF0586 protein C1778.07 n=1 Tax= Schizosaccharomyces pombe RepID=YOI7_SCHPO
caggtgcccaatggtcaaaaaggttaaacattgtctttgtgcttttatttgattgaccgaaaaccgatagtttaaaaaagaatatttgttatattttcctttacaaaaaactttgatctttgtgactacttaaagtgcgtaaattacaactgaatcatataaaatgaacggggatagtgcaaatgcagaacgagcctatttcttgtcagtactttcaacttttaaaagctacagagaacaatcacttctaagaatacaacacaaagaagaatgccttgaggaactaccttatcaccacaaagaatggctggaaaagtacaaaaaagacttaggagaaataaaaaaggtatagagaaaaattctgaatttatcccattagtactaagacaagctcactgtatatttgaaaacgtttatgcaaatgaaacaacatctcattcagaacaagcggtaggaactctatcagaaggtttggacaaagtacaatcagtttttaaacagttaatgcgtgactggagctcgttgggagctctcgaacgcaagcagtgctaccaacctatttttgaagaaatctttacgaattatcccgaagataaatttgacagaagcaatatacgcgtcttggtacctggagcgggcctcggtagactcgcgttcgaaatagc

SEQ ID NO: 347 - DNA, 605 bp, Diabrotica virgifera
  Annotation=Mitochondrial NADH:ubiquinone oxidoreductase B14.7 subunit, putative
  SmartBlast Evalue=6E-30; Info=Mitochondrial NADH:ubiquinone oxidoreductase B14.7 subunit, putative n=1 Tax=Aedes aegypti RepID=Q1HQR1_AEDAE
aaatatttttattgtattaaagactatcatttaaaatatacataatttacaaaacatatcattccctgccagtagtccagttacctggcctttctttagttaatgtaaaatcataattccaagcattttggctagctacaggagccacacttggtgtaacctcccagttgttatctgccattatttttctgcatacagcaagtatgccgaaaaacattccacaattaaatccaatcatggcatgtctcttccaggctcccacaacagatcctgctgaaaaaccaccaatgaaccaattccaaacatcgtcctttttgcggaaacttgcagaagcatttgtaacgagcacaaaagctgcacttgctcctacaatagggaatcccatatatgcatatcgtcccagagttggtaggtaccccttgggatgtgaccaggcaactacatcaattgttccaataccaaatgcagttaatgaagctggtttcataacgcacaagaatttatctaaaacatcgtggccgtctgggctatcgaaataactataagactttatttccttagtttgcgacattttcgaaattatgtaaggtgtcaaaattccaaat

SEQ ID NO: 348 - DNA, 590 bp, Diabrotica virgifera
  Annotation=Mitochondrial ribosomal protein, L9, putative
  SmartBlast Evalue=3E-34; Info=Mitochondrial ribosomal protein, L9, putative n=1 Tax=Aedes aegypti RepID=Q16Q66_AEDAE
aagaaaattaaattaggttaggttttcgctgaagatttattaaatatttattattatttaagataaaattatataaatatgtggaaatcagcactttctacagtgacttctacactaaaaacccaaagtacactactaacagccactgatttggtgtatcaacaatctagaacgacttatgtgttaaaaagaaaaaaccccgtgttactaagtaagaagggacatcccaaaaagccattaaggagtaaacattatgtatatgaagttgtaagagacactcaccatgaacctcagaccaacattgaagttgttctaacttcggttgtagaaggtttagggaacgtaggtgataaagtgtcagtaaaagcgaataaagcatacaataatttattactaactggtttagctgtgtatccaaccccagaaaatgaggcgaaatataaaagtgctggacaaagtaaagatttactgaaatacagttctccttcagcagcgtatactgtccagtcactttccagaatgatgttatcagttgttatgaataaagaaacaccatggacaataaagccgtggcatatcaaagcgtcatt

SEQ ID NO: 349 - DNA, 552 bp, Diabrotica virgifera
  Annotation=MKI67 FHA domain-interacting nucleolar phosphoprotein-like
  SmartBlast Evalue=7E-26; Info=MKI67 FHA domain-interacting nucleolar phosphoprotein-like n=1 Tax=Harpegnathos saltator RepID=E2BLE1_9HYME
gtccagctttatattaaccagatattgtttttgcctcctaactttggaggaatacctagtaattgtgttaggtttgcccataaataatccctttggtcgcttttcaggtgcaacaaaattagctgttattcgcttcttaaacattaagtagttgttcatagtttctgctgcaatcttggctacttctgggttcacaaactcaacatagccataccctttgctgtttcctgtcttgccggacctacaaactataacattggtaactttaccaaattgtgtgaagtatttcttaagttcatcttcatagaaaccatgaggcaagtgggatataaatataagacctcttttttgctcttgggctgcaattagagctttctttgtacctttaactgtgacggttccatcctttattttcttttttaactgttttgtctctttgacaacttctttttgttttgatttttccaaagataaaacttctgctgctcgagttttagtcattttattaaaattaaataaaacagaaaaatcaaaccaaaattttatatttgg

SEQ ID NO: 350 - DNA, 696 bp, Diabrotica virgifera
  Annotation=Mitochondrial ribosomal protein L1
  SmartBlast Evalue=2E-37; Info=Mitochondrial ribosomal protein L1 n=1 Tax=Aedes aegypti RepID=Q17CA4_AEDAE
attgtgttgggctcaactatttgttacggtagttctttaataattaaaaaatacataatagtaacaaattaatacaacatgaattttctctccttacgtaccttccagactaccgtttttcagactctacaaaacaatgtaatcagatcagcccctgaatctttaaatataatacaagccaggtgctatgcagctaggaaaggaaccagagatcgtaagaagaaggctaaagtaaaagtagaaatccaaaaagttggatttataccacataatcaaagaaatagagagaagttcctagctagtcggcccaaactaaaatttgatgattcgggaatgagagatccagtagatgatgtgtttgtttgtaaatactataaatgggttgtgtatcctttccaagaggctgttaaagctcatagagaaactcatcaccctgaaatgtataatagacctgaaacagatttacatgtcactgtagaattaaatatggagggtgaaaagaagactcgattgctagataattttacaagaactgttggaattccccaccggttcgaccaaggagaaattccgtctgtggctgcgttcgccaaaacccaagaaatacaaaaacttgccattgatgctggtgcccagctggtcggcggggttgacatgatcaagaaaattcaagttggggaactcaatcttaatgac

SEQ ID NO: 351 - DNA, 695 bp, Diabrotica virgifera
  Annotation=Putative pterin-4-alpha-carbinolamine dehydratase
  SmartBlast Evalue=1E-35; Info=Putative pterin-4-alpha- carbinolamine dehydratase n=1 Tax=Diaphorina citri RepID=Q0PXW3_ DIACI
attagtaaaagaatatggttaaactttacaagcaataaaataatcaaccttattttgataaatcataaatctatataaaaatgaccagcttatttatgatgattaataagatcggtagcaagaatcaagttagacttggtgcactggaaagtccctttcatcttttcacattcatccgcaacttgaccttgacgacagtggatttaacacagaagtctggtaaatctaaattgaaaatgcaagcaaagcttaatgaagtggagaggaatacctcactagcccctctgttctctcaaggatggaaattggttgaaaaccgggatgctattaacaaggagtttttgtttaaagattttaatcaggcttttggttttatgagccgcacagctcttcttgctgaaaagatggatcaccacccagaatggtttaatgtatacaacaaagtacaagttaccttgtcttcacacgatgttaatggattaagtggaagagatgtaaaactggcaaacttcatggaagatgttgccaaaggtattaagtcttaaaaaataatatggacctcaagtttctgtaatatgataacaatctcgatatacaataagactatcttataattatgttttgttgactgttagaagactttatttacatttgttttggataaatctacatttgtttgttaataaactgtgcat

SEQ ID NO: 352 - DNA, 461 bp, Diabrotica virgifera
  Annotation=Ecsit
  SmartBlast Evalue=4E-41; Info=Ecsit n=1 Tax=Culex quinquefasciatus RepID=B0W9N2_CULQU
tgacgtcatcaggatctttgtcttctaatagaactggctttggatctcctcttaatacaaaataatttatagggtttccttttatccaaattctaaaagcaccttctacaaaaattggtttctctatcttatgttcactaagcaaccttctttgtattttactttgtgcactaacaatccaggtatcatctattgaatctggaatatccacagtttggtatacactaacaacagagttcacatcaacactactaatcctttcaatcgcatacttggctaaatcaaaagtgtctttaggtaacggatcgggtacaggccaaggagatagatttttaaatttaggcatccagtacatcatcctccagtattttctaagaggataacctcttttccataaatatttagtaacaaactttccatttcaatgtcgggcataacgccatttattcctccattttgtt

SEQ ID NO: 353 - DNA, 720 bp, Diabrotica virgifera
  Annotation=Probable 39S ribosomal protein L49, mitochondrial (Fragment)
  SmartBlast Evalue=8E-28; Info=Probable 39S ribosomal protein L49, mitochondrial (Fragment) n=1 Tax=Harpegnathos saltator RepID=E2C8I4_9HYME
gttaatattatacaaactttttatttaaaatgtctcttaagtataatttaacacgactagtaaataagagattaatttctgttgccgataacttgagataccagattagactgggtagctaccaatcctcaccatacctagaagacttgggcgaagtaaacacaaaatatgaaatatcgaaagaccccgaggaatggaagtatgtcgaacgagcgttaccaccaacaattattccggaacccatccagaaagataagtatccctcaggatggaagccacaagccgaaaacttgctagatagacctattttatacaaagaacgaaaaaccacatgcttccagtttacctagatataacacaaaggggattaaggagacatacaattatcagaaaaatacaaggtgatatcaatttgttagagaaagagttattggaatttttgcagccacaatcatttcagcctatcaggagtcaagtacatgaattcgctgggtttattaggatgaatggtgactttgtaaatgctgtgaaatactttttagaaaaaagacagttttgaatagtttattttatagaatatcttgaaaattagagtttttattaaactatgtatctggatagtgataactagctttaaataagtgttaagctagaagtcattattaattatatctgtatatattatcatgtacaacatcttaagtcaaaaatgtatctctg

SEQ ID NO: 354 - DNA, 718 bp, Diabrotica virgifera
  Annotation=Brinker
  SmartBlast Evalue=2E-39; Info=Brinker n=1 Tax=Tribolium castaneum RepID=D6W8J6_TRICA
gtttatagtctattgaatttcaccattattattaagggattttattttgagtttaatatatttttgccactaccagaacctgtcatacctcagcagccccattctgacatttgggacttatcaacgaaaggcattaaacgtaagagtcctagtcctgaacctgtagtatctccaaaacctgtaaaattatttaaaccttacctagatgacattaaaactacggaagaaattaaagaagaacctccctattgtataaaaactactgaagaaatcaaagaagaacctctgtattgctctgctgccttatcaccatgtgaacctttatattgcagtaatgtatgtgatatcaaatcagaatataacagctcgtacaccttacacgaattgcaacccaacacaggtcttaattattactactacccatcttacccatccagtactgagtatgaatgccatggatactgctgtgaagatatcagctatggccaaaatgtggctccattaaaacacagacaaagttatagtttagatttcaaattgagtgccatagattgttactatcaagactctatttgtaagggaaaccagagagcagtcgctacaaagtataatattcatcggaggcagatacaaaaagtggttgaagcaggctgaagaactgagactccggaatgaatctttaaaacagatacatgctgtaaggtagattattgttaac

SEQ ID NO: 355 - DNA, 470 bp, Diabrotica virgifera
  Annotation=L-aminoadipate-semialdehyde dehydrogenase- phosphopantetheinyl transferase
  SmartBlast Evalue=8E-36; Info=L-aminoadipate-semialdehyde dehydrogenase-phosphopantetheinyl transferase n=1 Tax= Camponotus floridanus RepID=E2A9P9_9HYME
atcacttaatgcgacagaaacacaatggtcttcatccagtaatgattcttgaaatttgtagttcattttttctcctttgatggagagttctgtgtctgtaactatttttgaattgacagatttttggtgttgactttgaaagcaacctcctggaaatttagcgtcacaccaaaaccaatggctttaccatagctttcttttagtgcccaatgcctacaaaacatagctacttgctccttttcagatccagcatctctaatattaacccattcttgagcagagcattgcctattcataattctaaaaaactcgcttagggtttttccacccgaatattcaaatttcattacatctacacccaacagtaagttttcttgactctcaccaacacacacggtataattcccatgatgtgatacattaaaacacaaattattggtattattttcaagcagaggttttcctctttc

SEQ ID NO: 356 - DNA, 514 bp, Diabrotica virgifera
  Annotation=Insulin-degrading enzyme
  SmartBlast Evalue=2E-12; Info=Insulin-degrading enzyme n=1 Tax= Harpegnathos saltator RepID=E2C3Y0_9HYME
gcgctgttccttgtaccaagcattcatctcgtcggagaaattttcggaaaccgctagacggtccaactccaaactggtattaagggagttatgtaagggtgtaggggtgccactattatttatattttgatagttaggtgaagacatgcttttaggaagttcctcaaacttgtcacttaaacttttttggcttcttccactcacagataatttaggcttattcccttcagcatccgttttaactggtgattttttgaacttcgtcgagtatttataaaagtctgacatttcaaacggtttggtttcttcatggtaaggcttacagtgtcctgcttgaacgattgtacaattttttggtatgttattattaaacagctcgatgttggtttcgcgaacttttggtgaagggttggattcggctggaatctctttaggaactttatcttcagttagaaaacaggtatcggaggctgaggatgagacgatacggctgcaggtggtggttgtgatggag

SEQ ID NO: 357 - DNA, 387 bp, Diabrotica virgifera
  Annotation=Ubiquitin-fold modifier 1
  SmartBlast Evalue=2E-39; Info=Ubiquitin-fold modifier 1 n=7 Tax= Endopterygota RepID=UFM1_AEDAE
caacaagaaaagcttttcacatattttataagtaggaaacatattttaagttaaaattgagtttcttaaaactttaaaactgtggttttcgtataaaattattaataaaatatggcatccaaagtgacgtttaaaataactttaacatcagatccaaaacttccttttaaagtattgagtgttcctgaagccacaccttttacagctgtattaaagtttgctgctgaggaatttcaagttcctccagcaacatccgcaattattactgatgatggtataggtattaacccccaacaaacagctggtaatgtgtttctaaaacatggctcagacctcagactaataccaagagatagagtgggttgttgtaaataatatttatagtta

SEQ ID NO: 358 - DNA, 831 bp, Diabrotica virgifera
  Annotation=Autotransporter adhesin, putative
  SmartBlast Evalue=7E-33; Info=Autotransporter adhesin, putative n=1 Tax=Aedes aegypti RepID=Q16T50_AEDAE
gaaaacagcataaaacgtgtgataataggaaaactataatataaggatggtatcaattttttgaataacacaaatcaagagaaattttatattttactaaagtaataaaatgggtatcttttttagtaaaaaaagcctccctccagagtaacagaacacgataaagcagtgttacagctcaaacagcaaagagataaattgagacaataccaaaaaagaattgagctctcacttggtaaagataaagatatagctaagaagttacttaacaatggccaaagagacagagcaaaacttttacttaagaagaagaggtatcaagaacagctgttgtccaagctagatgtacaacttgataatctcgataaaatggctagtgatatagagttcgcccagttagaaactcaagtagtgagtggtctaaaagcaggcaacgaagctttgaaacaaattaatgattccctcaaaattgaagatattgaacgtatattggatgaaacaagagaagggattgacaaacagaatgagattaacgaacttcttagtggtcaattgacagatgaagatgaagcagctgtagaagaagaattggctggtatgattgagcaagagatgccttccgtgccttcagaagaacctaaagtggaagtcaatgaggaagaatcagaggatgaagaggaggtagctgataaagaaaaaccaaagcaaaaggaaaaacggaaagaggaacgtgtagcagtgatggcctaacaaattgttactttgttggtatttttcaaccatgtatgtaaatttcttaagttatttataagtaaagtaaacaaaactttt

SEQ ID NO: 359 - DNA, 715 bp, Diabrotica virgifera
  Annotation=TGF-beta activated kinase 1
  SmartBlast Evalue=5E-38; Info=TGF-beta activated kinase 1 n=1 Tax=Tribolium castaneum RepID=D6WXF9_TRICA
tgcctataagtacaaatgacgataagatctctaaaacgttacctcaaccctccgcggattttatgaagccgctcaccgtcgaatgtgatcccaaagtttgggatcaggaattggagcaaaattattatattcaaaccatggccggactagataaagctgttccgaaaaatggtacagccagctcaattcaagccggcgtggaaagttcctctacagaaaatctgcacgacaaccaagatactagtaatataaaagtccttctcgattcactagatccacatttgaggcctgtaacaccagactattccgatcctcagtcagtagctctgttaaacgaacatattcagttagcagaagaatattggaaggtccaaaccgaacttgtcctcttaacgcaaaagaaaaatatgttattagccgcaaaagaagaggacgaacgaaggaaaataaacctggagcacctccaagaagaaaaagaatcgttaatgttagccagagacttactgagacagcaaagatcttcctcgccagcaggtgattcgtctgaaggttcagcagaaaattgggtcatcgtgccaaggagagaacaacagagttgacgttattattattgttattatttattgtaagatattttttaatttaatattgtattaaattcataaaaattgtgtatattttaagatacaacttaatttttgtaaataaagtattg

SEQ ID NO: 360 - DNA, 551 bp, Diabrotica virgifera
  Annotation=Cyclin-dependent kinase 2-interacting protein
  SmartBlast Evalue=2E-14; Info=Cyclin-dependent kinase 2- interacting protein n=1 Tax=Camponotus floridanus RepID=E2A805_ 9HYME
gaagaatgaataatatgaaattagaaaagattatttgttgaaaattttgcacaccatttattatcatgcaaaataaaccagggacaccttcaaagtttcaacctttacagcttcctcaaagtcctgttataaattcgccaaataaaaatttaactggttcacctagagtggttagagacattgcggcagacgtttataacacaattcaaagttggaactctttttatatcaatggagcccaaattgtcaaacaaatagcaattttaaaagcaggtaacatagatgtatattctacagaactggaagaatacacaaatgcattgtatacatgtgttcaaggtttaaaacaatgcgacgagaaattgcagttgtgcaaacatcaaatgtgtgcattaaaaaaagttgaaagaaaattagaaccgctttttatatcactgaatataaatgatattgtggatttagttagtactattgttaattcatatgctgaagaatttaaggtgaaagaaatggtattagaaaatattgcgcatgccaaaaataaggatgaa

SEQ ID NO: 361 - DNA, 461 bp, Diabrotica virgifera
  Annotation=Cytochrome c oxidase assembly protein cox11
  SmartBlast Evalue=1E-31; Info=Cytochrome c oxidase assembly protein cox11 n=1 Tax=Aedes aegypti RepID=Q174W6_AEDAE
gatacacagttatctctgattgttggggcttaaaattccatctcatactggctgcagtatcagcattaaatttaatctttaatggtttttgttttactgctgacatggtttctactttttctgcatcatgacccgtggacactgttcctccatagctgtatgcttgacaaaatagcctatataacggtactgcggcataacttaaacctactgttgcaactcctgcagctgtgacataatatagagtcgatcttataccccgttttttagtttcatttgtattgttagaataaagtcttttaaaataattatttcttgcattattcctaatattgatgtgaatacttctattaactatagtttttacaatgttgaataagtaagtcatatttaattttcatttaaatgtttttattaatcatgtttatttcacttttattttatttttatattatttaacc

SEQ ID NO: 362 - DNA, 595 bp, Diabrotica virgifera
  Annotation=CKLF-like MARVEL transmembrane domain-containing protein 4
  SmartBlast Evalue=1E-38; Info=CKLF-like MARVEL transmembrane domain-containing protein 4 n=1 Tax=Camponotus floridanus RepID= E2AYQ6_9HYME
tagttgtcgagtttgataagcgtcgggaggtagcttagcgtgtggtgaaaaataaaataatgttctaagcctactaggcgaaaatactgtaaaataaaattatttctaagcaatagttaatttcaataacaggttaaaatggcggatccaggttttccaggaaagactgctaccacaactacagtacatacaaacagtactactacagttcaaaccaatgtgcggtttgatccattctatattagaaccatacctggaatactaaaatgtgttcaagtgacgctcaacttaataggattcatctgtatcgaatgcagcgggtggctagcgactcactcaagaggggccttcttcaatttcgtagctatgactggattttggtttaccggaatcctgttggctttctacttattccaccttatagaaaattccacagggtgccatggctaaagattgaattcatattttgtgccgtatggaccggattatatttgatagcggcgtctttagctatatcgtttcaccaagaagcctacattgcagctgggttcttcggcttctgcggcatggtagcgtacggaatcgacggtttctt

SEQ ID NO: 363 - DNA, 555 bp, Diabrotica virgifera
  Annotation=Small androgen receptor-interacting protein
  SmartBlast Evalue=7E-31; Info=Small androgen receptor- interacting protein n=1 Tax=Bombyx mori RepID=Q1HPJ0_BOMMO
ggattataataataattcagatgaatttttttatggaattatgaatttgtatatatttgtaataagaattttataattccctttaattactattagttatgtaaatatgtccgaattggagttacaagaggaagagagggaagctctgtcatcaatatatgaaggagatgatctgtttaaacagattgataagtgtacatatcaatataaatatggtgagcatgatacaaataaatcctttgtattggaaattaaatgggttgagcagtatccaaatgagttaccagttatgaatatggacacattttacaataatcacatagtaacatcattaaagcagaagatagtagaaatgttaaggactgaagctgaacaatacttaggaatgtctatgacttactctctatttgaatttttaaaggagaaattcgatgaactgattaatgatcagcctgacgaaccagaaaaattagaagttgaaaaattatgtatttctgaaggggaccaacaagaaaatctaaggaaagaaaaaaaggaacaactaaccaaagcgca

SEQ ID NO: 364 - DNA, 757 bp, Diabrotica virgifera
  Annotation=Stathmin
  SmartBlast Evalue=2E-29; Info=Stathmin n=1 Tax=Bombyx mori RepID=Q2F5V8_BOMMO
tttataatgatagataattgtaaccatgtgacggttccttcttctaaccagaagacgggatcagcttgccttcggcgaccagattggctttgttctggcgaacgagctcagctcgcttctcgtaactcttgagtttctctttctgctcttgttcgagctgttcttttcgtgattgagcctgctctagtttttctgtgatcgcaaggtccaactgttgcaattttatggtattttgctctctcaccttagctacttgttcttcgtgctcttttaggcgttccaacatctttttgatgttatcatcgcgttgttgagaagctgtcttcagtttatcttcaatagctgatctgacttcttctgtttgaacttccagagataaacgagtcttttcgacattttcgatatgatcctttagttttgaccttaagtcggtgatatatgcttcccttttctctacgtgagtgccctattttttgttctagagcatcgcgagtggtagatatgaattgacaagtcttttcgttctttttgcgactggcctcttcgattttcatgattttcgcagaccaagcagccattttgtttgattccaattgctgtctgcgttcctcagctgcctttagtttatcttcaatatcctggacggacatgctgcccttcggagagagtgacaactttggtgggggagctttgacatctggctcaccaaggatcacttcatagcgaagacctcctttggttttctcttgacaacgga

SEQ ID NO: 365 - DNA, 437 bp, Diabrotica virgifera
  Annotation=Prolactin regulatory element-binding protein
  SmartBlast Evalue=1E-29; Info=Prolactin regulatory element- binding protein n=1 Tax=Harpegnathos saltator RepID=E2C3T1_9HYME
atacgtggaacttagctataagttgtagttttgtagggtaaattcgtaggttttagtgaaagaaaatgtcgtcgaaaagaaaaagtaaagaaagcataattgctagggtgaatttcccactatatactcttcagatgttaacgtcaaggcatgtaatcgttggtggtggaggagggacatccaaaactggtgtacacaatggttttgaaatatttgagatttttcatgacggcacacgctttgcagcaaaagaagtaaccagacacgaaactggaggcaatgttgttatgaactgttctgtttacagtgatagaaaatattctcttttggtagctggacaagaaagtgagtgtcaattgtacaaactgaatcctaaactagtcgaggaagtggaaaatatcggtaataatactcatctcaggcaacggaatacaaaa

SEQ ID NO: 366 - DNA, 1524 bp, Diabrotica virgifera
  Annotation=Serine/threonine-protein phosphatase 4 regulatory subunit 2 n=2 Tax=melanogaster subgroup RepID=PP4R2_DROME
  SmartBlast Evalue=2E-34; Info=Serine/threonine-protein phosphatase 4 regulatory subunit 2 n=2 Tax=melanogaster subgroup RepID=PP4R2_DROME
ggtgtcaggtaattcattggtggcagtatctgcatcatttgtcgtttctatcttttcagattcactgatttcttcttgtggtagtttttcagagatatcttcttcctctttcttatcatcggttgaactatctacaatgttttccaattcttcaggtacagggacatctacttctggagcaacaggaagtgtatcttctggagcatctaatgatttctctaccaccacttctgcttctttatcttctatctccacagcaactgtaggttctgagatttctggtagtgattctagcacttctggttcacttggaccaggggttacttcttctgttgatatgtcttcaattggtgtttctgttggcagttctcttgtagattctacctgtgtaatttcaaactgtgtttcttctatcaatggttccgtgggttctatttcagcttcagtaattgattctggtttttgtacttctgtttcagtttgattaggcacatcggtggtatctactgcagtggtatctacctctaaggcttcttcagctggttgcttttcttctataggtacagtttctttaacttctggtacagatgctgaacttgaagaatcactactgttactgtctgtattgctatcttctgaaagattctgataggtaccttcttgaggttctatagaaacaaatgtttcaattgtctcctctgtacttgtgcaagttattacagtctctggggtttgtgcttttggttcttcagcagtactgcttgaaggtacttctgttttagtttcttccgtttcaaaactagttgctggctcctctgttgctggttccatttcacttttcgataagtcttcactctccccatttttgtaagaaacaggtacatcttgatcatgtctgttccaattagaaggactttcatccatgtcttcaatgttaatgtcgtgactagaattgctactttctggtaaatgttcagactctataccgttcataataccttcttcaccgttttcagcagaccttcggccaggctctactgtgcttacgaccagaatattcttctccaacgccctcatgtatttgtctattctgctgtattcctttcgaggcgtcgtgagaagttcacatatcctttggactgtgaaaggggctgatgcgaatgtgtcgagttttctagtataaaattcttcatcatatcataattgaacatttctacgttaggacaaggtggaatatcaacagacgggcaagattcgtagaagtccgtaataacgttgattagcttttctcggaaaagagactttattataggccattggtagataggattgcctgttttggcgacaaaacacaagtactcttctaattcacgtggaatgtcttttggtttcattttttgaaaattcttctagactatgaagaatttcttccgggttttccattgtggaacactgtgtaatatatttatttttaatatcaaacttatcgagtaacaacaaaagatgcacctgggtaacgtcaat

SEQ ID NO: 367 - DNA, 480 bp, Diabrotica virgifera
  Annotation=Zgc:152651 protein
  SmartBlast Evalue=4E-30; Info=Zgc:152651 protein n=3 Tax=Danio rerio RepID=A5PL71_DANRE
gttagattttggaaatgaaatttttatggatttctgaaaggataacagttagtgttttacctatacggcactactcgtcaaaaccaccatggaatgttctattttttggaacagatcaattctctttatatactttaaaattacttaatagataccattcgaagtctgaattaattaataaactagatgtactaactagtttgaaaaaaaatgccaatgttgttcataaatatgcagaaaaacataatcttcctctctatgactggccacatattcctggggataggacttatgatgtaggattggtagtctcttttggttacttgatacccgaagctattattgcaaagttccaatatggcatcctcaatgtccatgcaagtattttacctaaatggagaggagcagcacctataatacatgccattgcacatggagacaaagaatcaggtattacagtaatgagaattaagccacacc

SEQ ID NO: 368 - DNA, 333 bp, Diabrotica virgifera
  Annotation=Fau
  SmartBlast Evalue=6E-18; Info=Fau n=1 Tax=Drosophila yakuba RepID=B4PLC9_DROYA
caacactaagagacgccgatctccgaattttctcgccttttttgcccctcgaaaatccgaaaaaatggtttatgaaagcgatttttacacgaccaggaggccctatcgtgccactccttccgtttcgtcttacactatttcgaaacgtgagattccctgggagaaagtgccgttcgtgccgaggccgagtctcgttcccgatccaatcacagctttcgggaaaaggaaaccaccagcagaacaagccaagcccgagaggaaatccatcttgtcgcctgaggagagagcgaagatcaagcccaaggtacttctggagcctgtgaagccatacgt

SEQ ID NO: 369 - DNA, 603 bp, Diabrotica virgifera
  Annotation=Mitochondrial import inner membrane translocase subunit Tim10, putative
  SmartBlast Evalue=2E-28; Info=Mitochondrial import inner membrane translocase subunit Tim10, putative n=1 Tax=Pediculus humanus corporis RepID=E0VY47_PEDHC
ttctacatgaattaaataaattatgcccctaggtaattgggctaaaattggaattggttggtctgttgtagtagttgctggtatctattccttttatctagccaagtcgaatgttgaaaagaggcgctatgataatatgaaaataagagaacgtatgagagaagccaatagtggagattattcgcccagttatagaaaattttcgactataaagtccgaatcctaagcatttattatattatatttagttaaagactttacacttaaaaacaacacatcatgtcccaaaaagaagtgcaaaatatgcaactaatccaagagttggaaatagaaatgatggctgatatgtacaatagactgactgcaacttgtcacaagaaatgtgttcctccagtctatggagatgcggaaatagcaaaaggtgaagctgtgtgtttggacagatgtgttgctaagtttctagatatccatgaacgcattggcaaaaaactgggccaaatgtctatgcaagatgaagctttgttgaagaagtagtatgttaccgagtttagtagttgttataattgttctgtggtattttagttttgtttaaataaatagttg

SEQ ID NO: 370 - DNA, 489 bp, Diabrotica virgifera
  Annotation=NADH dehydrogenase 1 alpha subcomplex subunit 5
  SmartBlast Evalue=1E-29; Info=NADH dehydrogenase 1 alpha subcomplex subunit 5 n=1 Tax=Bombyx mori RepID=Q1G0N4_BOMMO
aaattttggtatttattctaaatatttacaaaggtgctaaatttctattttttacacatttaacaaattaactccttggttgagctggtggccaagtccattgggttggaggagcttcttttaatagaggttcccaaggcttccagttcaacatttttctggcaagtattaattcattttcagcttgtacaattacctcttcaatttgtccacatcctatttgtttttcgatagcaatgacatcagtagttgacttcaaaatctttgatctctcatttattatgtctgctgtgtattttctgtaggcggcatcctctggcattttttgtaaggtcctcaaaattttactgtataaaatacctaatgtatggtgaggatttttggccacagtaaggccagttaatccagttgcaagttttgcagctccagccatgttatttaatccaaatttatttcacgtaactggaactggaatgaaaatgaaagtat

SEQ ID NO: 371 - DNA, 600 bp, Diabrotica virgifera
  Annotation=Mitochondrial ribosomal protein, S18A, putative
  SmartBlast Evalue=1E-31; Info=Mitochondrial ribosomal protein, S18A, putative n=1 Tax=Aedes aegypti RepID=Q172K6_AEDAE
tattttatatttttttattctatgaataacttaattactaaaattcatcttattttgatggtgctctcatcaaaatatttattatatcttttccatctgtatctttttttggggtctttatggctataacctggtgttaagtttggcatcaatcctgatttttgagccatcgcaactaatgttgcaatgcgtttctgtgatcttgaacataaccctgtaatcctttttggcaacatgcacccatctgttcttacaaattgacttaggattaaaacgtctgtatgctttatgtctaatccagaagcacaaactgaacaggcagttggatgatcatttttcagtaaatacgattctcttccagaaggtacatgctttgcagagataattaattccttatcattctgaatttcttgtatttcttttaaccttagagcaggaaatatactaaagttttttatgttactattaagatctagtcgaatattttttatctgctttaataataaattcatcttgtcattaataattactgaacctgtactgaaattaaggattgaaattacgaataattcgtaatttcattaattattaatatttgag

SEQ ID NO: 372 - DNA, 586 bp, Diabrotica virgifera
  Annotation=Nuclear pore complex protein Nup107
  SmartBlast Evalue=1E-13; Info=Nuclear pore complex protein Nup107 n=1 Tax=Harpegnathos saltator RepID=E2BC48_9HYME
taggttatgaaagatggtttgaattttaattgtagccgcaaatttttttaattataaacaaaacttccagtttgataaaaactaaaatataaaataacatggataatgatcttgacaggtccattcgcttattggaaaatgctttatctacctctaacagaggtcttttcaagaagtcatttggaaaatcaaagttagctactgacaatatttctaatgtgtccatagcttctgcagatgatgatttaaggatatcatcagtaaaagcttccttaccagcgataatgcagtgtctaggatactgcagtctgatcaaactgtaactggaaatgttcttcaagccagtacagcaccttggaaaacggctctggatagtctttataccgaattttttgaaatacttacttcacactcaggtggctttgatatactggaagtagttaccgacttagctaggtgttgctctgatgcccttaaagtaattcagagtttgaagtcgaaggtagcagtttcgcagttagaagaagaaataagtttagagaaggaaaggaatacatggagattgctttttatcctttaccaagat

SEQ ID NO: 373 - DNA, 531 bp, Diabrotica virgifera
  Annotation=Protein phosphatase 1 regulatory subunit 14C, putative
  SmartBlast Evalue=7E-23; Info=Protein phosphatase 1 regulatory subunit 14C, putative n=1 Tax=Pediculus humanus corporis RepID= E0VZG3_PEDHC
gcgtttgacgcggttcgtcgtctttagtgcacgaaattgagctgtctttatcttattattgaactttctgtggactctgtgccagtgtttgtgttatttcagggcggtggttcatctctgctccgactaaaataacctgtttatatcaaaccatcaccccccgaaccttaacaaaatggagtgcggcgtaacgggagcgagttacacgaacggcactacgcccgggggcggcggaggagggggcggcattctcgcagacgtgaggtcggaaaggtcaccggccaagacgggcttgcacgtcaatttcaaggacaagggagaaatcaaggagaagcgggagaagtttctcaccgccaagtacggacaccaccaaatgagtctcatcaggaagcggctcgccgtggaaatgtggctgtacgaagagatgaagaaactctatgaatgtaaaagtgcgaaacaagtagatcctgtaaataatgacgaagttgaggtagatatagacgaactactagatatggacagtgacgacga

SEQ ID NO: 374 - DNA, 494 bp, Diabrotica virgifera
  Annotation=FAM98A
  SmartBlast Evalue=2E-20; Info=FAM98A n=1 Tax=Culex quinquefasciatus RepID=B0WD70_CULQU
ctttctactgtaagctgtaagcgcaacgcacgtcaagcaagagtcaagatactgggattattagaccggcggaatcgaaattaaatgcttttggataaggttctaaaaaaacttattgtgctttgaaattattcatttaaaaatgaataagctagaagaaaaaataatatccggtttaaacaacataggatataatggacctttactcacaaaacctaattttccgttggctatagaaagtggaccgaaaagtttagaatatacagaacttgtaaatttccttacaaatgagataagaactttagaggatatagatgaagaagttaatgctattacttcaccagaagatgctgtagcttttatcatggaagtcacatcattcttaaaagaattaaattgtccttataaatctcttctagagggacatgtatctgaaagattacaaaatgtatctgatagattattgctgcttgattatctgatgacagaactaa

SEQ ID NO: 375 - DNA, 1052 bp, Diabrotica virgifera
  Annotation=RNA-binding protein with serine-rich domain 1
  SmartBlast Evalue=2E-25; Info=RNA-binding protein with serine- rich domain 1 n=1 Tax=Camponotus floridanus RepID=E2AVC5_9HYME
ctgaagcggtgagttttgagtttattagtgtttaagtttagtgttacttttttcgctaatttatataaaaatataaactatttcttcgttttaaaatggctaagccaggaacggactcggaatccgataaagaaaagaaaaaagagcgaggaagagaaaagaaaaaacgttcagcttcaggaagtagcagtagtagtaaaagcagttcttcagacagtagttcttccagttccagatcttctagttcgtcaagctctgcttctagctctcgatctagcagttcttcgtctgattcttcatcgtcaagcagtgacaataatagaaccaggtcaagaaaaaggtctggttctactgctaaacctgcagccaaaggaagagatgtaaaagataaagaaaaagataaggataaggacaagaaggaaacaaaagataaggataaagaaaaagagagagtagattccaaaaaagatgaaaaagaaaagaagggcttaactccaaccaaagaaagagataaagataaggagagggatagaaatcatatccgtaatagatctaggtcgagatcaccaaggaaacaacgccgtcgtcgttctccaactcctcgtcccacaaaaattcatattggtcggctcaccagaactgtcaataaagagcatattatggaaatatttggaacatatggcagtattaaacatgtggaatttccaaaagatcataaccatcaacatttgggacgcttatattgctatgttgagtatactactgctgacgaggcagaaaatgcaatgaagcatatggatggaggtcaaattgatggacaggaaataacagcagccccagtattgatcccaaaaccgaggcctatgcctccaaggagatcacctcttcctccaattagacgaggacctatacataggagaacaccccctaggtttagaagaagaatgtcccctagacctagaagatcatcccctagacgcagacaacattctagaagtccgccacctagaagaaggaaacattctagatctagctctagtagttcttaatta

SEQ ID NO: 376 - DNA, 454 bp, Diabrotica virgifera
  Annotation=Coiled-coil domain-containing protein 58
  SmartBlast Evalue=6E-22; Info=Coiled-coil domain-containing protein 58 n=1 Tax=Camponotus floridanus RepID=E2AKH3_9HYME
ggttagataaccatttttggttaagttaaatcctttaaatcttaaattatttttaactcaagaagtgtactatgccctctgctataatggaatgcccagatattggtgaatttgaggatgctttaaaagctatgagaaaaccacatgatttgatcataaacacaataaataccgtagtccccacagattcgttccatgtagatcctgttgagtcttgtaaaaaactgtacgagagcttagagactggtaataaacaaagagaggatttcataaaaaattgtattacagtaacatcagaacgagttagaaagatgaaggagcagagagatagtaatgctaatgatatacaattatcaaaacaacttcgaaccgaacaaactacactcagagtccttcaagtagagttaacagtagaagatttaattaagacagcgaactgccaaagtatttaacg

SEQ ID NO: 377 - DNA, 573 bp, Diabrotica virgifera
  Annotation=28S ribosomal protein S16
  SmartBlast Evalue=7E-35; Info=28S ribosomal protein S16 n=1 Tax= Culex quinquefasciatus RepID=B0WR13_CULQU
caaactgtatttgaaaattgattctatataataaatacataaaaagattggttttaaataaaaatggcacacaatattaaaaaactgagtgtttcaatgagtaaagcgggaatgccatttccagtacctacaaagattattagatttgttaggaaaggttgtactaatagaccctttttccacatagtagttgcagatgctagatcagatcagcacgacccttcaatagaacaacttggaactcatgatcctttcccaaatgaacacaatgaaaaattaacatccttaaacttcgaaagaattcgatattggttatcacatggagcgattgcaacaaatcctgttcttgaattattaggtcttgcaggattctatcctattcaccccaggagttatatgactgcttggagaaacagggaaaaggcaaaacaagcttctgaagctgctgaacagaccaaagaggagaaaagttaataacatgtcatttacttctgtgttgtgtgtacattttagtatgtttaagtagatataagtctattattttgtaaaaagtcattataaacatataaactc

SEQ ID NO: 378 - DNA, 460 bp, Diabrotica virgifera
  Annotation=Glyoxylate/hydroxypyruvate reductase A
  SmartBlast Evalue=1E-23; Info=Glyoxylate/hydroxypyruvate reductase A n=1 Tax=Camponotus floridanus RepID=E2AUJ7_9HYME
cctataatggatatatttttaatttgcaaatcatacttttaagttaataaaatgcattcggtaatatctgtgttaagtagaataaaaaatattgttcccgagcttcaaaatgctttaccaaatttgacatttcacgaagtctctaatgcagaattggataagcagttcaaggaatcccacataatagtagcagattacgacctactaacaccgcacatgtacagtttacctcaagccaaatgggtacaaggaacatgggcaggtgttaacgatttaatggcaaaagttactcaacctccaccattttcacttagcagattcaccggaaggcattttggggcgttaatgagcgaatatgttgttgctaatattataaactttgagaggaatgcatttgagactcaccagaaccaaaaaatgaagcagtggatagtagatggaaaaatagaggagcatagag

SEQ ID NO: 379 - DNA, 420 bp, Diabrotica virgifera
  Annotation=Transmembrane protein 50A
  SmartBlast Evalue=1E-40; Info=Transmembrane protein 50A n=2 Tax= Formicidae RepID=E2A724_9HYME
cttgtcaaattagaatgaaattttgagattagtattgtttaccttataaaatacaataaattagcaaaatggccattgaatgtttcgaaaatattagtatgcctccgtgtatatggttcgagggaggagataaacgaaatgctctagcttcgatgttagcaggcttattgttttttactggatggtggatagtcatagatgcagctagcgtttacggcaatatcctagctggttaccatatgtgcggagttgtaggaacagtctctttgcttatggtaaattctgtatccaatgcacagatgagaggtgatgcctatgaaggaggctgcatgggatcacgtggaactaggatttggctgttttaggtttcgttattgggttttgctgcagtgatagcctcgtgttggatattatttgctg

SEQ ID NO: 380 - DNA, 418 bp, Diabrotica virgifera
  Annotation=NADH dehydrogenase [ubiquinone] 1 subunit C2
  SmartBlast Evalue=6E-34; Info=NADH dehydrogenase [ubiquinone] 1 subunit C2 n=1 Tax=Tribolium castaneum RepID=D2A2K1_TRICA
caaaaatggcaactggtccaaaaattgctacaactcctttggagttatttgaaggatatagagaaccaccgtttttaagtaaagtatggagtccactaatatttggtaccatgggattcgttagtgtaattctagctaattatgggaccaggaaacctgtcttcagcggtatccagaaacacattctagctactgctatttgtggtggtgttggaaaaatagtagatgattataggaacaaatacttagcagacagagatgctgtacttcgtcattatatagaactacaccctgaagattttccagcttttgagagaaaacaatacaaagacgtctttgaagcttggattcctattcgttaatagtttaatataagtttatgtagtaggtatatattctgaatttaaatatattattt

SEQ ID NO: 381 - DNA, 746 bp, Diabrotica virgifera
  Annotation=Mediator complex
  SmartBlast Evalue=4E-27; Info=Mediator complex n=1 Tax=Culex quinquefasciatus RepID=B0XAF2_CULQU
attgatacataattttgtaaaaaaaagtagcaataaatcaatacatttttaaataaataaatccaacaagattattactaaaaatttaagataagtaggtattgatactatttcattttctttcgaatggtatcgtgagcatccttgattcgattttgaaaattggcacttacgtccctcattagagctctaaactgttcagggtttagtttttcatggagtcgctgctcttctatgaagttttttccagaaaacattactcttactactaactgtgcagctctacgcatcggatacgattcgctaagtttttgcaccaagtgttcattgttagctaataatctgattaggaaacgaaataccattttatgacttttgtgtttcaaaagggtacatataacggtacttctgcagtagttcttgtttaagtcttagttgagttttaagtgcttcaaggtgatttaattgttgttctttactgtaatcaatacctggaagcatccggatctcagctctggcttgatctagtcttttttgtagctctaaaactttttgagaacaatcttgcgaatcccttgtctttgccgtattatcgtgatgattatctttctcaacacttttgataatatcgtatattattggtaaaatgtctatattaagatcctcaacacttaatatcttattattgttttcaatattttgctcttctgtgtccatcttttagcatttcaaaatagaaaattttg

SEQ ID NO: 382 - DNA, 568 bp, Diabrotica virgifera
  Annotation=DNL-type zinc finger protein
  SmartBlast Evalue=1E-26; Info=DNL-type zinc finger protein n=2 Tax=Danio rerio RepID=DNLZ_DANRE
gtgaaagtttaataattatttataaaagtattgtctaatttacagtaatgttcacaagatccatttctagtgtactatgtcgtacaatcagaaaatcgacgtttcaagctataaataatggcttaaaacactctcatccacaaccaccaaggttcctaagacattgctccacattgattcaaccaaagcctgattctaccacgaacaaaccacaaccgattggaaaagtcaaaggaaaactatttttaggctacaaatgtaaagtttgtagcaccaacaacagtcatttcatatctaaagtagcctacgaaaagggtgttgttattgtaacttgtgaaggttgtaaaaatcaccatctgatagctgataatttgaaatggtttactgatctggacggaaagcggaacattgaagacattctagcagaaaagggcgaaagtattaggaaagtcgatatggaaaggtgtatagaagtcattaaagaagaggtgaaataattttgtttgttgtaactttatttataactccaaactgtgataattgttttgattaatataggaatacattt

SEQ ID NO: 383 - DNA, 354 bp, Diabrotica virgifera
  Annotation=Ubiquinol-cytochrome c reductase, complex III subunit VII
  SmartBlast Evalue=1E-33; Info=Ubiquinol-cytochrome c reductase, complex III subunit VII n=1 Tax=Tribolium castaneum RepID= D2A1S3_TRICA
agtgaagatttttgtcggagttgtctgcaggtgattctttgtaaaacgggtaacaatggggcacggattcggtcaattgtacaaactgcgaggtattattacctacaaaatctcccacttcgaacaaaaagcctttactggaatgatatcgcatggagttccaaacaccatcagaagaatactagaccaggttctctacgttgtgcccccacttggaattggatatatagtgtatgatcaagttgaaaaggaacaccacagattgatgttgaaaaatccagctgattatgaaaatgataagtgaataaagtgatagtcttcaattgtaggttaagttaacagtaaaaaactatt

SEQ ID NO: 384 - DNA, 512 bp, Diabrotica virgifera
  misc_feature (462)..(464): n is a, c, g, or t
  Annotation=F13E9.13, mitochondrial
  SmartBlast Evalue=2E-41; Info=F13E9.13, mitochondrial n=1 Tax= Salmo salar RepID=B5X9D2_SALSA
atttgaaccatgtgttttattaattttatttcatcctataattatcccattaatcaaaacaaaagtgttggcttgtggaaataaagaggcacttgcaattgcaaaagcatgttctatggatctcattagagctgaaggttttgtgtttagccacgtagcggacgaaggatttacggatgctaacgcaggtaacattttgcggtacagaaaaagcatagaagctgataacgtacttgtttttaccgatatcaaaaagaaacatagctctcacgcaataacgaacgatatatccttagtagaaactgccaaagctgccgatttctttctttccaatggtggattttaacaggaactgcaacaggacatgctgccgatatcaaggaattacaacagttaaaatcaagtatcagcttaccagtcttaataggttccggagttacttatgaaaacttggagaactannngacagctgatgccctgatagtgggttcgtattttaaaaaagatggaaa

SEQ ID NO: 385 - DNA, 775 bp, Diabrotica virgifera
  Annotation=Protein YIPF6
  SmartBlast Evalue=4E-86; Info=Protein YIPF6 n=2 Tax=Formicidae RepID=E2AIL7_9HYME
gtgacacatagattatagataaacaaactgaaatggcaaatcttcatcaatttagaaattattaatgattacattagaataactagcacaaaaatggatacggcaaagctagagatgtttgacgaaggggaagaatacgtggatggggaaatgaacattccaaaaccaaaaaacaccactcagataggagagccggatttcaatactttaaatgagcctattcgcgatacaatattaagggacttaaaagctgtcggaataaaatttgcttatgtattgttcccaaaagagaagaagactttgttgaaagaatgggacttatggggacctttgctgttgtgcaccctcatggcgatgtttctccaaggttccagtgatgacacaagcaaaaatgatggtggtcctgaatttgcacaagtatttgtaattgtatggattggatccatgattgtaacactaaattctaagttactgggaggaaacatatctttcttccaaagtgtatgtgttctaggatactgtctgcttcccacgtcaattgcccttatcgtctgtagaattcttttattacttcaccaaattcctctcgtatttttcataagatttgttgtgtctatggtaggattcatttgggcaacttacgcttcaatgattttcttaggggacagccagaagccaaataggaagctattagcagtatacccaataggacttttttattttattatatcatggttagtgatttctaaaacaaatacataataagttataaaag

SEQ ID NO: 386 - DNA, 1126 bp, Diabrotica virgifera
  Annotation=BAG domain-containing protein Samui
  SmartBlast Evalue=6E-29; Info=BAG domain-containing protein Samui n=1 Tax=Bombyx mori RepID=BAGS_BOMMO
gctctctgctgcatctttgctttctttattatctactgaagctacttcggcaacagcagattctttggaaactggggcagctgtttcttctttagcagatgcgttagtttccgattcactggtaggattcactggtaactggtcaggttgagagttctcagtaacttccatatttttagtttcctcgacattcttttgttcgtttgatacttcgcttttttcttctggtttgttggtctcttttgtttccccaccagcaactttttgatctacatccattttttcttccttcgacgctttactttctaatagagcaatagcttgctgtatacatttaatcgcttcttttctggcctgacggatagtgtcttgtccttgagtatctatattatctaatttaattagatttctagtcaacatttcgtctaaatatagatactgcttatctctagatttccctgcaaacttttcaacctgttccattaaactggaaacatccttttggatttcttgaatttgctctatgggagtaggtttgcgatcctgagaagcaggtttagcttcttcctcttccgttgcttgtggtattggttgctgttgttgggaaggtggaggttgttggtaaggttgctgcggctgttgatggtgctgcggctgttgatggtgctgcggctgttggtggtgctgcggctgttgatgatgctgcggttgttgatggtgctgctgctgttgttggtggtgctgctgctgttgcggctcttgttgatgctgctgttgttgatgctgctgaggttgttgcttcctctcaaagttttctctttgtacaggaataggaatatcttctttaggatgttgataatattgtggttgtgatggatgttgtggatggtactgctggaaattatgaggtatattttgccgagtgaaatgttcatcttgaaaacctcttggaaaaggttctggtcgatgtccaaatctgtctggcatgggatgcgactgtgggggaggtatgttaggattttttgggaagactggtccatccactccctctacttgaataggaataatcctttcatttgatttctgctctggttgttgactttgagacatgttttcggaaggtacg

SEQ ID NO: 387 - DNA, 574 bp, Diabrotica virgifera
  Annotation=Amsh
  SmartBlast Evalue=2E-24; Info=Amsh n=1 Tax=Aedes aegypti RepID= Q176G0_AEDAE
acaaatatgagtcacacacaactagaaaacttaattttttaatgtagttactgactgatttaaaacatttaatataaaaaaaaaatggcaaacagaaaaacgaatgatcatattttagacacattagaacctcaaattcgcttgaaacagctaatagactacatcaaccaagtagaagctgaccccaatgttccccctataaggtactatcgttcaggccaggaatggtcagaatggctaatgtgtattacaaagaaggtagcttggaaaatgcttatgtcctgtatttgaagtttatgactctttttcttgaaaagattagaaagcatcctggatttgcttctgtagcggttgatattaaagccaaaaaccaagctaccttaagggaaatattaccgaaggctgaaaaacttaaatcgttattattggagcagtatactactgactatcagagatgtctacaagaaaggaaagaattggaacgaaaaaggaaagaggaacaagccaaagtcgcagtgcgtccaacacctaaattgcctattacaccatctgctccacaacaagttgtcgtagc

SEQ ID NO: 388 - DNA, 630 bp, Diabrotica virgifera
  Annotation=Transcription elongation factor 1-like protein
  SmartBlast Evalue=7E-30; Info=Transcription elongation factor 1- like protein n=2 Tax=Aculeata RepID=E2AFU8_9HYME
ggcgtcgaaaagtcattttaccccaaatatggacttacgttgttttcgaaatgaccgattcaattatttaataaaaatagatgttaaaaactcccattaattcggtgtcgatacttgggagtgtaaaaaccccacaaaaatagtaaacaaaagtactgaaaccatattttttataaagtcccattgaataaaaaattgtaaagtaaaaaatgaaacatcatgctttaatctttaatacagagatgttcttgtgtaatagaaaatgtttatcactaacacacacttaagtatctgactaattcttatacactataatataatatattaattagcagtttcacatgcatcaatccaatcattgtagacatcaactggctcagacagaaagtttatagttgtttggaaatcttctaaacaaacccgacatgttatccgagctgtactcctccctttatccattttaacatcacaggatttctcgtgattgcaaaatgggcagttaaacagtatgtccaatggttctatagcttttctttttggtggaggctttctttttgactttcgacgacccattttttatcttcagtggaaaattttaaaagtaaaatgttaattaaactttatcgttac

SEQ ID NO: 389 - DNA, 1632 bp, Diabrotica virgifera
  Annotation=Tumor protein p53-inducible nuclear protein 1
  SmartBlast Evalue=9E-13; Info=Tumor protein p53-inducible nuclear protein 1 n=1 Tax=Harpegnathos saltator RepID=E2BG71_ 9HYME
aaagtctcgatgatatcgacgaagaagataacgtcatcgagcgagttcttacccgaacgagttcaacgtcgtcgctaccctgcgggtccaacatggaggaatcctggttcgttacacctcctccatgttttacctcggaaggacctatccatatggaaacctcaccgttggaaaacctccttatcgaacatcccagcatgagtgtataccatatacacccaagcagaaggcatttcaccgttactgttccagtaaggcccccttcttcggcttctagattaagcgatgaagaagaggatcttgaagtggaggaagagaacgtagaaggagaagccgtagcagtggttaacagggtacccagattgaatcgtctgcaagttatgcaacaacaggagagacaaaggcataagagcaaacgagctcaaaaggtccaaatgcaaaaggcttgccaggccatcaaacggggtaatctggaaaggaataacaaggctcgtgaagtaaacagtcgcaaccgtcgacaaaggcgtggggaacgttcccagggtgctacccgctcctacgccaacaacaatcgcaagtgctaagcttgcaatccattgatctctttacttgcaacatccagtctacaacagattttcatctgtcagtctgacatactacgaacacaatgcttcaaatgactgttaaacaacaagcgatagctagatgcatccttgttgtacgaaaatatattatagtgttcttagtatgacagtgaaatttttacagcaacttgtagaaactgtacttccaatgatatttttaagcaattttgagcaactggtaaatttttgttcaaaaatacaaaatttatgtatacatttcagaacagtggtactttctacaagttatactgtagatatattgtattaacggtcagataacttcattctggattttcattatatatccgtttatgaataaggggaatattgattaaaaaatcccttttaattgtatatatgtttctcgtcgaaggtctggagtgaaattcttagtattaaaattctcaaagtaaaaaaatagcacgagtgataacaaaacgattaccaaagcaccgtgttgtgttcaaaacgatttgagatgtttgtttaataaattcgttgagactggatgtttcggttacaatgtttttacgtctttcagtttaatttacaatattcttaacgattaatcagactacctgataggctcttggtatggacggttgagagaaccaaccaacaaaaggtgacacagtttgctattggttaaatttaaacttatggtttcatgtcggtccatgtacttctgggatccccttccagaaaatcttgccatttgttggttggttttagttattaatttattaatattggccagttgggcgcctgagtagtgtgattaaaaattcctgtagatacagatatattttattaataattattttagtgagacgatttttttaaagaataatttatttttgttgatttcttcccacaggcaattatttttacttatgtaatagggaatcatgataatcacgaacgtcccaatcgaccataaagctacagtcaaatcagactggaaataatagaaaattgcttgctgttt

SEQ ID NO: 390 - DNA, 544 bp, Diabrotica virgifera
  Annotation=Novel protein
ttgggcccacatgttcatcgtgaagctccctccacaccctcactattatgttcacaataaaccaaacagcgttgacaatatccacagcaaaagcagaaacctaccagttgggttccaaaacaacggaaaacctgctaagatataccactggaatctacctctgatgaagaaggcagcttcaacacacaaagctaaatcagatgattatcttatggatttcaggcatcaggagagctggaatgaagttttagataaaccgatgaaggaaaagaaaccgcacaaaccttactactacgttcctgccaaacccaagaaatctggttttactaaatacttccctggtaacggaaaacctcactctttctatgttatagaaaagagtaagaaggctcattaccataggctgttgccgtaaaaaaagtgtaaataagaactttgtgcaatatattatgtatctatactagactgaccttttaagcttaattctaattttatatattatattgtaataaacctgaacgtttttacaataaaattcttaacc

SEQ ID NO: 391 - DNA, 561 bp, Diabrotica virgifera
  Annotation=Guanine nucleotide-releasing factor 2
  SmartBlast Evalue=3E-10; Info=Guanine nucleotide-releasing factor 2 n=1 Tax=Harpegnathos saltator RepID=E2C8C1_9HYME
acacagtgagtaccagtaccagtaattcgatgttaagtaacagcacaagcagggacgttgtagacttcgctgatgtagatataccaccggcgttgccccaaaagacgaagaaaaagactgaaaggcatccgtcaccgtacgataacgtacctgaggaaaaaataggtgaattgttaataacctgcgagaggcatcaatcacaccagagtttatccagttgtacgagcagtacaactaataattgggatcaagatgccaaaccaccacctttacctccaaagaaaaaacacataatggcctacatggaaatgttcggaaattgctcccacaccaacgatcaggaattcatgaggcactcggtacacatggtccaatatacgcaaccgatggcaggaggtttaccgacgacgcagtcgtgcacgttcagccaatcgcatgcgtcgaatcgaacgtcacatagccatattcagacgttgagtttaccgcctagatctgatgaccggtctccctcgccacttcattcaccaaaccctatcacttctacttcaaatacttcatcgc

SEQ ID NO: 392 - DNA, 505 bp, Diabrotica virgifera
  misc_feature (480)..(480): n is a, c, g, or t
  Annotation=Novel protein
gccagaactactgccggatcttcttcggcgtcgactttttgggcttctgtggcggagtcagttaccagaagatgcgattgaggtggtagggagccttccaaaaaagatttcctgaggtggtgtatcggagagatgtggatgagctgctggcaccgatggtgaaccggaacgagtccacttttggccattttcacgactagcggtagtttccataccgagtacttggactgaagattgatcgtcttcctggttaagaagagatccgttagccacaacttcttcctgtataacctcactagccttacgacgagatgacagctccaaatctacttcgtccaatagcgctgacatagcgtttacaactaatttgctggaagagctttctttggatctcgaactcaaatgaccccggtcagcttcaaaaacttctcgcctaaagtgaggatcggggtttaacggtggatatagaacttctggttntttcttgaacacaatcttcatacgg

SEQ ID NO: 393 - DNA, 415 bp, Diabrotica virgifera
  Annotation=Mitochondrial NADH-ubiquinone oxidoreductase 9 kDa subunit-like protein
  SmartBlast Evalue=1E-14; Info=Mitochondrial NADH-ubiquinone oxidoreductase 9 kDa subunit-like protein n=1 Tax=Aedes aegypti RepID=Q1HQW7_AEDAE
ttctcaataaatttgtttatttactattctaaaacataaactttaactaaatttaatctatttggaggtaggatagtatggtacatgcacagatggttgggggcaacgatgttctagcatttctacttcagcttcgaagtaactgtttttatcataacagaagtattctggattcttatacccagtattttttgcagctccaggacctacaggtgagctgggtacttttacacaattgtcagaaaggccaggtacattaggaatagaaccaccagaagattgtgatttattgtaaattatcttgcctgatgataaagctctgtttatacttgaaaagttacaaaacttgctataattatttaaattccttaaaagccctttacttgccattttcccttatttggaaggttagaat

SEQ ID NO: 394 - DNA, 445 bp, Diabrotica virgifera
  Annotation=Sirtuin-5
  SmartBlast Evalue=3E-24; Info=Sirtuin-5 n=1 Tax=Aplysia californica RepID=D7PD35_APLCA
gtaattgtactgttgtacatacatcataataatcattgttataataacatgggtattgtacattaataggatatatgcgattaattaaaatccaatattaagtttaaactagtaactaaagtcagctaataaaataagaaataaggggtatgtcgacgtcttttaggatgattagcaggcaaattgcgcctcgtctatataaaatgggaaaacgtaaactgagtgattatgcaggttttagcaaatgtttaaatgaagcaaaaaatgtagctgttttaacaggtgctggagtgtctgcagaatcaggaatacccgttttccgaggggctggtggcttttggagaacccacagatctcaagatctagccactccacaagcttttgctgctaatcctgctttggtttgggagttttatcactacagaagaaatattgctttcaattc

SEQ ID NO: 395 - DNA, 636 bp, Diabrotica virgifera
  Annotation=TP53RK-binding protein
  SmartBlast Evalue=1E-27; Info=TP53RK-binding protein n=1 Tax= Camponotus floridanus RepID=E2ALG0_9HYME
tttatttttaaattctgtgtctgtgtcctacctttataatggagatagatccagaaacacaacagaaagtttatatgaaactatacactcatataaaaaacgcaccgcaattaagagaaaaattggtgaagggtgatttaaaatgtactatagtcaaaccttcattgatatgtgatgcttttcaagtccttgctgcagttaataaggcgtttaccagtgaaatattaaacagaaattgttatgtagaagtgctctattgtttaggtaatagtaaaaataacagttccaacttggtaacctttggttttacagataattgtactagtggtttagttgtgactgttagtaaaggagataatgatgaagacatttataaacatattgaaggggatgaggtgcctttagatagactatctgaatttactgatgaacagttgataaggaaaacttataaaattggtgataaagaggctagtgttactccaatgctagattcagtagtgagtagaattgccaccaaagattttttatagatttttaaattgtaagctcatgtaatttgaggcgctcagagcaacagtggcctaagccacaaattgaacatttttagattaacatatcaataaaagcagcgac

SEQ ID NO: 396 - DNA, 525 bp, Diabrotica virgifera
  Annotation=Transferrin (Fragment)
  SmartBlast Evalue=3E-12; Info=Transferrin (Fragment) n=1 Tax= Aedes aegypti RepID=Q16KL8_AEDAE
cgactcacagtaaaacattcttaacggaataaactaaatataaacaagtcacaaataaaaacaatgaaaatgtaaatctactattactcgaaccagacatcaaacattgacggtcactatttaaagaggtttcgtacacaaacggcattggatcgttttctttaagggtcggtacagttctcaacttctctgtcacatcgtggaacagtaagtcatgttcgtcgtcatatcttccgaacatagtaaacgcattcgtcgtagatttgtagtttttcccgaaaagttcgtctagttgtaggaaaacatctagggtgtctttcttccagagttctgtagcgttgccccttaccatggcttgaccaacaggcgcccaactcaggtggcacgctgatgttttgtttatgcaactcgcttgtatctggactacttcgtttgcatggtaggctgccataaatttagaaatagaattttgggacacgaaagccacatctccctttccactagccaagcaatgtagggctccaa

SEQ ID NO: 397 - DNA, 525 bp, Diabrotica virgifera
  Annotation=Novel protein
tgttcttgaagtactgacacctggagtatcttttttagaaacagggctagacagtctgattttttgctcgatctcttctgctacaaaatgcgtcatgtttccctcaatatgtacagaaccttccaaatttaacggttttggatttgtgtagggcaaagtcatgggtcttttaacctcttctccgatttgtagtgactctagggttgaagacataggaatgtcgtcttcaggactctgaccaccagatttaaacgaaatctcactgtaagattgtgtcatttgttgagatatttcatcttcgtctagatctacttcaccttctgcttggggctcagaggaatgagaaactgttaatggtctatctggtattttggttgaaggttgtgttggaatgtgcttctctttaaattccatgtctggtaagttattgctacgaattgtattaaaatgtatctgaattcgcacacaagtatactaaaatttttaattttctattttagtaataaaatcttaccattctggtac

SEQ ID NO: 398 - DNA, 471 bp, Diabrotica virgifera
  Annotation=Regulatory factor X domain-containing protein 2
  SmartBlast Evalue=0.000000002; Info=Regulatory factor X domain- containing protein 2 n=1 Tax=Camponotus floridanus RepID=E2A4H8_ 9HYME
atgaagaagaactgtcaaaatacttctgcaacaataactttccagaaacaacagaatcggaagatacatcaaaattgtcaacgcttaggcagctgcttgttcaaaacaatatcgtagacaccaaaccgtcaatattagaaaacagggtagtggaaccaaaaagtgtgtcctttccaaatacttgtcaaaatcaaatgccagtacaaactaattttacacatgttaatcctatgaattttcaagaactttctaccacaaatgctaacgttaagagaagggtcagcttcgagatgtccgccacggagaattccgtaccaccaagtccaaatacaagaagaaaaaatttcagttttacacctatatcaccgggtccacagtctccaagtggcatacattctaaatgctctagtacatcagtaagtcctttcgtcagtcctagaagtacgcctgttttaagaagcaagccggctc

SEQ ID NO: 399 - DNA, 504 bp, Diabrotica virgifera
  Annotation=Novel protein
ttggtcagctcagttccagtgaaaaataaaaggaacaattaaaaaaagtcactttaattgagggtttaggcagagtaaaacaacaattgtattgatttatcactagtatcaaaatgaatactgctataaatataggtgtagaagacatgactgtaaccatagtccgctatggtttatatttaggtgcgatattccaaatagtttgtctagtagcttgtatttttatatctgactcaccagaagacaatctttcatggggctcgaggatcgacagtgacgatgaaagttctgaacaaagtaccccacaaaatactccaagaaggccttatcatagaggcagaaagcaagaaaagaaaaagagacgttaaagcctatacatattatgtttagtctgtactatctgtggaattaggattttatatttgtgtgatattaacttatttttaaaagctttcttagtggtagctgcatgcgttatttcttttataactgaaaactatttgg

SEQ ID NO: 400 - DNA, 475 bp, Diabrotica virgifera
  Annotation=Polyadenylate-binding protein-interacting protein, putative
  SmartBlast Evalue=2E-13; Info=Polyadenylate-binding protein- interacting protein, putative n=1 Tax=Pediculus humanus corporis RepID=E0VNJ8_PEDHC
cctcagtaaaacattattgtaggccatgatagtagccataaacttagtatgaaatcaaagctttgttaaagttaagacacattgaatcctgttaaattgtccgtaagaatcaagcaaacagctgttaaaaccctttcctgtggcgttttgaatattactatgaaaatgcctggcaaccagaaagcagataacgggcactacgaatacgaggaaaattcctactttacggaaggaattgagaacaacgtagttgaagattttaatacggcccccgaaaatgacttttcggagtacatgtggatggagcacgaggaggaattcgataaggaggtcatgcaaagactagaagaagaggcattaatggaagaatgtctgcaggcattcatgaatgatgaaaataatttggcgaatactcagctccaagatgtgaactctgctcagtcccaacaaagtgttccggcaccagagagcatcg

SEQ ID NO: 401 - DNA, 538 bp, Diabrotica virgifera
  Annotation=Pallidin
  SmartBlast Evalue=1E-14; Info=Pallidin n=1 Tax=Harpegnathos saltator RepID=E2C3D6_9HYME
aaaaataggcttttattacttattttaaacatttttcagtaactatgggaagtgcttcagaaatcaatccttataatgattctgtgaaaaatctttctgaaggcctactcgctatttataaaccagctttaaccaatgtacaaagtcaactaaaggaactcaccagtaaacaaacttttttggtaactcaaatacaccaagaaaatttagatttagcagaagtacaatactcgccggagatacaggatatgtttaaaaaaatgaatctatatcacagtaaattaaccaatatcaagaaagacatgaagcaattacatgaaagaagtgttaaattaaaaaagagagccttaaagttacagcagattaaagagaaagaaaagttagcaaaactacagaatgaacttgaaattaaacgtgaaacggagctaataggtcctgggcctagcaaatctgatctcaaaggggtaataacgttactgggtttagtttttaagcaattttatgtgattataaagaatttaataaatttgttatattt

SEQ ID NO: 402 - DNA, 539 bp, Diabrotica virgifera
  Annotation=Signal recognition particle 14 kDa protein
  SmartBlast Evalue=6E-20; Info=Signal recognition particle 14 kDa protein n=2 Tax=Formicidae RepID=E2A848_9HYME
catgttatatgtattttccttacaaaggtgattgcaatacataatgaaaaaatgataacctaattgtatttaagtattaaaagtaacaaaaataaatataaatatattattctgcttttgtctttgttttgggcttctttaatttctttaaaccatctatattgccctttagaagactgctataggctacttggaatttattaacatctctctggtggattactgtggcaatcttcttcgacctggacttggctcttactaaacaaaaatgttcttgaggctctggaataggaggttttccgggacgtggattgggccgatttcgtccattatatcttttaaatgtcatagttactgacccatctagacgagacttctggaataacttggtcaactctagcaaaaaagtatcattctctaataacaccattttcaatttgaagaaagctggaaggaaaataatttgagaaatatgttttttctctaaaaataaccttttacttttaattaaaattaattgaaattaatacagattgaac

SEQ ID NO: 403 - DNA, 341 bp, Diabrotica virgifera
  Annotation=Proteasome assembly chaperone 2
  SmartBlast Evalue=8E-13; Info=Proteasome assembly chaperone 2 n= 1 Tax=Camponotus floridanus RepID=E2A7M8_9HYME
ttcaatggttgatctcaattgaaaacaagcaattttcaaatcttcgtttgcatataattcgcacgctgtacatatttcagaagaactactgttataaggatcagcaccgactgtaggaacaatcgaggaatgccatactgaagctactttttctaaattgtaagttttgatgagcaggtctactgttaactgtggaacatttccaacagaaacacacggtaatattatcacaaaatcgcccagatttgtaggtttgaaatatcttaatagcgcaggcattttatattaattagttttaagattttttcgcaataattcagattcacaatagtgactaaaca

SEQ ID NO: 404 - DNA, 608 bp, Diabrotica virgifera
  Annotation=Zinc finger protein 509
  SmartBlast Evalue=6E-17; Info=Zinc finger protein 509 n=1 Tax= Culex quinquefasciatus RepID=B0W205_CULQU
tgccgaagtagtttaaaaaagcacatattataaaactctctaaaaatagttccaaaataaatatatgattctattagtgttcaaagaaaaaattatgactacctattgcatttattggataaggtgcttttgtggagtcgtgtaatttagtcaaaaaggaaaacagtgcaaaaagagagttacctaaatgggggataatttcgtagaaactgtaatagaacttcacagatcgaagtcttggaaagagattttaaacctaaatacacattctgataaccaaaatgcgttgaaattattatgggtgtggcctgaaatcaaaaacataagatatatcaaaaatttagtaaaagatctcggatataaaggaatagtatctttaggttgtggatgtggtcttctagaatggattataagcgaagctacaggtttgccagtgttgggatacgaaataaacccagaatggtgggagagtaaatattccaattacaaatttattaatctacactacgtacacagcatttcgaaaaaacgttagattcaaactacgcattattgttctgttactttaatgacagagaggcattccaaaaatatgtagagaactacag

SEQ ID NO: 405 - DNA, 581 bp, Diabrotica virgifera
  Annotation=Polyglutamine-binding protein, putative
  SmartBlast Evalue=3E-15; Info=Polyglutamine-binding protein, putative n=1 Tax=Pediculus humanus corporis RepID=E0W331_PEDHC
ggtgcagggtatggtctttgctgatacagaacaccagatgctgtattatctgtccctttttgttattttccaaaccgtcactccacccaccttgtggaatatcagaataagcagcaggatccataggatcaatctcatcttttctctttttgtgtctttcttccctccttcgttttctttcttctctctccctctccttttccctttctcgctctcgttcacgttctcttcttcgatgatttctctcttcctcatccgaacttctgtcccgatctcgctccctttctcgttctctttcacggtccctttccctctcccgtttttcgttttctttctctttttccaggcgttcttcccgttccttcattttcaaacgattttcacgaagttttgctgcgctttgccctttcacggattgagggtgctttgggggaagccaagaaacaagatcattctccatattccagtaataatatcgtcctgttcctttgtcaaatatttcagtccaatttgatggaatagggtatttcactaataacttttgcaagtttctaaaatactttggatcaggtcgtttgtac

SEQ ID NO: 406 - DNA, 566 bp, Diabrotica virgifera
  Annotation=HCaRG protein; Pfam: PF07258
acaacacagaaaaatgtattttgattaatgtgagattcgtaggatttataaataaagatattttgcaaaaagaacaaagaaatgaaatcataattaagtctgtatactaatatatagtgccataataaaaaaatgaatatatcagagttatccaaaaataccattaacctggtctcagagattccaaatgactatagaaataagatattaaaattggtattctcctcatatctgttaacagaacaggaaagaacgaaaactgttcttaatttatcaagagatataagtattcctaaagaagacctagaagaaattttaggtgtatatttgatgtttgttacactttttttgcgatttgatgataacgaatttgttgagcggttaacggaaattggattttctccagaatttatagaaaatttgccattaataggaaatcgagaaagcattatagagaatttaagaaggagctatactgaaacttttggaaagctatctttatttcggtggagaattgatatcagtttaagtaatagtgatttagttaaagttcccaatgttgtggt

SEQ ID NO: 407 - DNA, 597 bp, Diabrotica virgifera
  Annotation=Protein lunapark-B
  SmartBlast Evalue=2E-14; Info=Protein lunapark-B n=1 Tax= Camponotus floridanus RepID=E1ZW26_9HYME
tttaataaagcgacgtgaaagttaaaacgtgagtgagacgatgataataagtgacttgcacgtacagacgcttgttttgctaataaaatttgattgtaaaacattagtgccggatcagtcaaatccaaaaaagtattttaggttagaaaaaaactgaaaaaagtcaactaaaaaattactcattgccggccaatttaatcagtttcgttaataacccacctaccagttcattttgaaactacttaaagcaatatgggactcataatagcaaaatttaggaagaagaaaagcacatacgaggtgttagaaaagttagagaatgagatagtctctatagaagaatttggcagaggtacagagctgtacagaaaaaaagtgattggtagatttatattgctagctgttttaacttatttaatactatcgtgtttaatttattattattacaaccggatatcgtcgaacaataaactcatctacatcatacctctcgtcgcattctctttcatcgtagttattattaaaaaattccttgcgtggtattatgccataaagctgcaaagaaacgaaaagaaactagtaaagttgagagaagac

SEQ ID NO: 408 - DNA, 1081 bp, Diabrotica virgifera
  Annotation=Polyadenylate-binding protein-interacting protein 1
  SmartBlast Evalue=0.000000008; Info=Polyadenylate-binding protein-interacting protein 1 n=12 Tax=Theria RepID=PAIP1_MOUSE
catttggaagtgtgtgtattttgtttatttctttttgtcagataaattcaataaaagttactttcgtctgatgtgcggacagttactagaaacgttattaattaatatttaaccatgaacaaccgaactgttctgtgggaccccaatgcggacaaacgcaatacgacgttaaggcaacccaaaggattaactattacacagcagtctgcaccctcaagttctccaaatacaactcctagagatgaaacacctcgtctaagtagtaaatcactcgtggatagggaaacgttggtggctaattcaacgttgaacgcaagtgctactgaatggtatcctaaaaatatttatactccttctccagttgaagttattacctctagtgttcaaaaacggttacaaatacatagagagtgtccacaagtaaataatattaataatgagggtacagaagaatactcaccggacctaaatcggattaaacaaataattaccacactaacaaaagatcctggacaatttcatgatttgatagacctgtttatggaaacgttggtaccatatcttgaagatattatgataacatccttagtagctgaaattattgttgaacaggcgataaactctcccaactttaggtatacagcagcgaggttgtgttggactattgaaccggtttctccacagttccgggcagagttacatttgaaatgtaaaaagcaaatagacgataatcccgacccaaaaaacgtcttaccgttaatagctgaattgtatatacagctgccgcatctccacgtttatggaacgctattatttaaattatttaaaaagttgcttgatattggaggcaatgaaaatattaagactatatgccaagctttgaagttgactggatattcgttggaacaaagtaataagtcagagttagatatgatattcagtcacctcagatcagttagaaatagagtagatggctctgcagcatttttatggattctctctatccgttaagagcatcgaattggggactattttactgaagaatcagaatccgaatcagatgatgcaggatttgatggta

SEQ ID NO: 409 - DNA, 799 bp, Diabrotica virgifera
  Annotation= Peptidase family S49 N-terminal; Pfam: PF08496
ctaaaaactacataatttcatcagtatattttttataatattaattgtgtaacaattatattctgatagaattactaattttatattaagttacaacccttttgatgtaattcttgaatttctcatgctgcttgtcttgcagcttcgcgatcttattcttggctttttcgtctttacatctagcacatacctcttttgtaaggccatgtaatgggctctggtaataaaaggacagatcttctagttctttgttctttctgtgaatgcgagtatgtaaaaatatttctatcacgcaaacaaaaacgagcatgatgggatggaagaatatcattgtcggtagtagaaagatagccgcggtaatcaactgtgactccaggggatctgctttacgtggagtgcagttggttttttcttttctttcttggtatcttctgtagtagtagcttgggattttaaaagttctggtatattcgtactcccccgtttcgacattttggactgcgggggcttcggatatttctccagtttcaaggtctaggtaaaattctccagtttcagcatccatttttggtttcgtttaaaatttttgttatgccatttccagaaatccaaacaaaaccaattattatcacaaacacaaatacatcagcttcgtgaaatgtccatacaataactaattttttattcaccagtaaaaggttgaaggtcaggaaaaattatacagggcacaatcacatcctcttttattagaaatacacaaattcactgaacacacggtaaaaactcaagtgtattgtat

SEQ ID NO: 410 - DNA, 692 bp, Diabrotica virgifera
  Annotation=alba-like protein; Pfam: PF01918
  SmartBlast Evalue=6E-15; Info=Transmembrane protein n=1 Tax= Bombyx mori RepID=B9VTS6_BOMMO
aagcatccgaataaaattataataacgaaatacgcgttcagtgcatctcctgcgaacaaggggaaaaagatgaaccaccagtctatactatctaggtctgatgtaggatcatattttaaggcaaagataatagtaaacagcagaagggatatcaaattgatccacagttcaaagacggtaagtcccagccagcggattagttcttctgtggtaaaaaacatttcaggataacattggctgtgaattatatactcgaattcttaatgcagagttgaatctcttctgaatttcataatcggcatcatccacagatggctctaagtcatctaaaagttcagtagttagagtgctagtagagactttgtaggtgatatgttcttcgcacaactgcagagctagtaaaatccccctctgtattgctgctcccatgcaataaataataatttcgtcatgcttgttgtttaacaacttgttacatctatcaagttgtgccttgacattggttttagaagaaacgtataaaacgttttctcctgtctctgttttctttgggggtctcggaagacgtgtgtgatcttttaaagacttttttggattctttttatacggagttgattttgattccagtttattatcagccattaaagctacaaagcatagataatattttaacaagaaaataacaatatttt

SEQ ID NO: 411 - DNA, 609 bp, Diabrotica virgifera
  Annotation=Pre-rRNA-processing protein TSR2; Pfam: PF10273
cattgtgttgggccacattgaaatggagtaaatgaaaatataaacaattactttaatttacaaagatttgcacaatggccgaagaaattcttcataaaatcgtacagcatatttgtagcaactggactgggttgaaattagcagtcgaacattctatgggtggaccaaacagtaaacagcttgcaattgaatgtgtagacgaagtgacagctttttgcacacaggagcaaaatttggaagtagaggatttagaagacttattagaagaccttatggatgaaaaatttgatatgctttttgaagatggttctcctaaagaaattgctaccatattatataaatttgtacagttactaaaaagtggaaaccttcaacaatgtgaagaagaatatcttaaacttccaacagcaaatactacctggttgcaagaaagtaaagcacaagctactcaaccacagcaggttgatagtgagtcatctagtgatgaagaagcaggtgagaaatctgtaacaccaatggaagatgatggttggacagttgtacaaacaagaagaaaaaaataattatttttattttatttataagtatatgtatattaaagttttgttt

SEQ ID NO: 412 - DNA, 624 bp, Diabrotica virgifera
  Annotation=Ribosome-associated membrane protein
  SmartBlast Evalue=3E-23; Info=Ribosome-associated membrane protein n=1 Tax=Xenopsylla cheopis RepID=A2IAC7_9NEOP
tctgttttgaaaattattttatattgaaaaaatagactcagttacataaatgcaaatgaactaacattggaatggtaaaaaatctcaaaaaagtacctacaattataaaattgagttgtcaaatgcaaataactgtatattatttctaaagcctttagaagactttaacgtatgagaattatatacacataatttatatttaaaggattgcacaatacgaaataaacggaaatatattaaaaatccaaattaaacatatatttttaaataaaatataagatttacaagattaagccatgcggattgattggatgatttggaaaacggcggatccacatactacaaacacaaaaagtgccaatagccatggtcctacaggtgatgattcttgactttgttttgttgattttggtacatttcctctcaaagtgacattcttcatggctttctcgttagccagacgcattctttgtttaggagccattttttaaatactatttatagtaaattccgcaaaggaacaaaaagaaaatgaggcttttcggtctcacgtcttccttctttcaattgcaaacgtagagtggttttgaaatacaagaaaataatcaacatttgatgacaacg

SEQ ID NO: 413 - DNA, 597 bp, Diabrotica virgifera
  Annotation=Novel protein
ggcacgctttggttacattcaaaatgacacatctggtttggacttgcactgttttcttctgtttgctggctgtactcaacttaggagaatgtaaagcattaggaaatgatattgatactcaacaaaaggatacctcctcttctaaggggtcctctttggaaatcaagaagcctaaggaaacacctagagcgataatatctactacaactgaagatgccgtcagctttgctccaggagaaccagtttccttgcaaataccagataaaatatttggctcatcgtttactttaattaccaatctttctactcggattggagattacttaatgaattctgctgtgcgagcccaaagacttcttgagtcgatgagaccattctttagagctattgcaggagataagtcactagtgattgaagggccttcagataaacctattttctctgatggtacggctacgtaaataatccatagtttgcagttaggattactggaacctatgttactttaaaaaattggtggattctatatatttcttctagaaaattgtttcatttgaattgctgtactgtaaatatgtagttaaaaataaattcgtt

SEQ ID NO: 414 - DNA, 1292 bp, Diabrotica virgifera
  Annotation=Intraflagellar transport protein 122-like protein
  SmartBlast Evalue=5E-15; Info=Intraflagellar transport protein 122-like protein n=1 Tax=Harpegnathos saltator RepID=E2BZC1_ 9HYME
caataacattgtttacttaatttaaatttcctgattatttgtttacaatattaataagattacaataataaattaaataaataaaaagtgatagcattctaaggacatctacttaacagttgatatttaatgttgaatccttgttttttctcttcatcagtagtgaagttcgttttttgtgaattgaaatgaacgtagaaaggaccgggagcgtatgatctgaaatcttcaggttggttcaggcacactttggagattaagctgttggacggtgacattagatcatcaaaatatagttctggtacatacaaatagtgcatacagtcgttgtcaccgtgaagtccaagggaattgtcgtaaggtaggtacatatagtcaggtacaaatcttattccacatacgccaatctccctcttgaaagcaatagcatattgttgcccataagtataactctgttgattactcacagaaccatcgaaaccaaatgacttaatatatccagtagattcagaaaagtattgtatggcacccaaaggagctagtagtggaaaatcttcgattatgtctttattttctccaaagtttataccagagcgatgaccaggacactcaagttgtgtaattttaattctccaagttggagaaaacagtaacgggttgtagtttctgtttgctagagtcatctgcaactggactcctttggttactccgtcggtctggttaacgtggatataaacatgttgtttatcattatttccacatagatctggaatattgaagtggttcggggttactctaaatatgtcatcaacacatctgtatgatttataagatgcatactgcggtgtggttagagtggctggggctaagttaaattttatgaagtccaaccttatttgacaaatattcttgttcctgaggttaactatatattcacagttggtttgtccattgccaagttctgttgtctcgaagtagcttactttggcattactggttttccgcacgtactttcataaacacagcaggtttggagaataccacaaaatccgttcggtgttccttgtgagagaagacaactggcgtatgggacgcactgaccccatttgacaccattttgcgtttgaacttgacattctgttgttttcagttttattcgttcaccctgcggccacacagaatttaaaggatcttcatcggcgaagtcaaaaatctccccgttcgagactctcaagagggccactacacaaaaaattagcaacatctcaatcggctccctctttcttcaaaag

SEQ ID NO: 415 - DNA, 589 bp, Diabrotica virgifera
  Annotation=Chromatin accessibility complex protein 1
  SmartBlast Evalue=2E-13; Info=Chromatin accessibility complex protein 1 n=1 Tax=Harpegnathos saltator RepID=E2B816_9HYME
gtttgcttattgttcaacgcctgttttttcgccatgatatttttgtattctaaaactgtgatttttttgggcattatgtccctaagaaaattatatttttcttctgcgtgcactatttcagctatatgtttgtagtctaattttttagcttggttagctttcttgtaaccttctagcgctaacatccctataaacatttctgttgctttactcatgagcaaaagaagattgtttatctacattgtccacatctgaagagctcttcatgattgtgttaatccttgacactggcaagtgagccctcttcttcgaagctgcgttctccattttataatgagatttttcgtattaaaatagaagggtctctgctaaaaaaccataatattaaatattattccaatgtgaaacgttattccttttgaactgatgtatattgttgttttatttcaaattcacactgcacaacagaacaacaaaaaccgttgtttgtatcctagtgaaacaaattgcacactaataaaactgaatgaaatagaacattttttagtacggcaagcaaataataaatgcaaccagaagggcagaacgg

SEQ ID NO: 416 - DNA, 724 bp, Diabrotica virgifera
  Annotation=Cag pathogenicity island protein Cag12; Pfam: PF13117
tttgtaacagatttgtgcattactataagtgtaaatattgataaagaaccaataaaaaagtaaaccgaaaatcccacaaattgaaagtattactgtcgtaggtatatagtcgtccagaggattgtgatcaactggtagtattggccatataattaactgaaaaaacatacagagcaacattgctgaacctaatgtaagttgaatatatccccacgcactgtctgagagtgccattattcatcaaaatattcctcttcaaacttcttgaaatcttcttctgtaaatgccgttttcttttgttgtttgggtttgattttcttaattggtcttctagatacagctcgattaataatctgttttaccagtttttcgtccaattctactttgctagctcttttaatcaattctagtttctttagattatctttaaggatctgttcctttgatttattatattttcttgcttctgttactgtcagtttcttttctgtagatagaagattgactttttctgtttttcctttcctttgtgctttacctataagtttttggctctggtgagctagtgcaaagacatcagatttgctttttcttttaccaattttactaccatattgtgggtctacaatttgtaaactttttcgaactagcgcagcactcatcataaaatcatttatctatttaattagagtatattaaagattaaagaaactttcatactttc

SEQ ID NO: 417 - DNA, 2164 bp, Diabrotica virgifera
  Annotation=Novel protein
aataaacaacgaccgggaaagttcttgtgtgtatcgttaacgttttctgttaagtagatcgtgaaaatatatattaaaaatgtctgaagtggactcagtaaacactaataatgctgtaaatgaagaaaatagtcaagaagaaaaaagttccaaaactaggaaatccaagtccaagtctcctagactaacaacaattgagagggctcgagaagaaagcgaagctattactaagggcttgggacctgaggttgaaggcaggcgcagaacgaggtcagcagctaaaggtgtgacagccactcctccacctccagctaagaaagaaagaaaaagttctagcacaactaaatcatcgagaggcaggccgaagagaactgtagaagaaagtagtgattcacatgatgaaaaatctgaaacctcagtagcagaaagtgaagaacaagcaaaaagtatcgatgaatccaaaagtgaagctgacactacagaaaccaattcacatgatgacaaagaagaatctggtaacaacaatgctgatgcttctaagtgtgaagatcaggcaatgagtgttgacgaaaagagtgaagctgatggtaatgaaactaattcacatgatgacaaggaggaatctgctaataataatgctgatgctaaggatgaagcagacgcagatgcagaggaatctactcctgcacctgctgccacagagaatggagcgaaagaggatagtgtagatgctcccgcctccgaagaagaaaagaaagacgaggaagaagagagcaaaagtactgccgacgaacctgaatcggcaagcactgagcagacggaagatgaaaagcctgctgaataaagatttttatattatttccaaattttattatcagctcgtttttctatttcattaattctactgtaggttaacaaagaattcatttttaaaaagttttggaaaagtgactcgtcaaaacacaaaattttcctgaaatatttgatttgtgattgaaagttgtattagtttttttttcttgaggttagtttgtgtatgagctgcgccatggaagtttgcgagataattactgttaataataatatattatatagattaggagtcattcttttgtatatttcttaattttttcatttgttttgatggcaattaacatttaaagtattcatctttacctacaggctagtttgaaagaattaggagacatgccgaagtacatattataagcggcgtatgtaccagtatgtacctgaatctccttaactcaatgctgtcaacttttcatttgcataaaaaactgttgatacttatctgaaatagcctttaaaaaagtatgactgaaacattttttgggtgttgtgagttttgtaatacgttttgtaataaacagtaaaatttcttccacattttagtatctcgtaggatgatgtatagtaaatggtacttagacatagcttgtaaggaaattagacacattttcatttttttgtgttaattaagttttatttgcaaatgaaaagtttctattttataccatttaaaaaatatttagtaatgtttagtaaaccttaagaataaaatagttttaatacattcgtctgttttcaattgtaaattgaatatttgattattttgactagattcatattgctggtttaataaacgtttttttttattaatttgtgattttatagcaaccccatttgtttttctatatctgaatcggatgtcttgaggactgtctgcttaaatatatcaaaaaagtatcatttacttaatcataaaaaatatatatgcatattttgaggagaactagcctattcattattgcattttaatacacactgtaagtttacaaaatgcaaacaaatttagtcatattcagcacattgtatataaaatcagtagatgcctaaggtattattattcattattaaaaacttttgtttggcataaaatgatttcatcacagattcagagactgtcatcgttattttgttacacacaaatatatgtttggcaatgaccttcgcttcatatccattagtagtcacagttcagcttgaataaattagtgaatgtctaaataaaaacttttcagtttaggactagtacatttttagtttgttaggcgagaagtgtgtaaagatcaatttagggggc

SEQ ID NO: 418 - DNA, 643 bp, Diabrotica virgifera
  Annotation=Mitochondrial NADH:ubiquinone oxidoreductase ESSS subunit, putative
  SmartBlast Evalue=2E-16; Info=Mitochondrial NADH:ubiquinone oxidoreductase ESSS subunit, putative n=1 Tax=Aedes aegypti RepID=Q0IEU1_AEDAE
aggtttattaaagattaaggattgaaacattgactattagtacctattataaaagtctttagatacataatttccaaaccaaagtcacaccgacatccttcataaatatacaatttacacagctcttgagagtatttaaataataatttctacgccttccaattcttcatctgatggcaatgtaatttttgatggatctacaaaattagcatctatgggtggcagcccttgttcttctctcctccgcaattctaaaaaggcttccctttgtgcccaatcccttaaattatagtcgggcatgtaggcaaagaagagtgttcccataactatacatagggtgattgagacgaacattattgaatgcatggcatttcggtcatctgttttcgacgtgtactcatacccgtaacttatccagttttggtctgctacttttgctttagattttgcagcatctactgcttctgctgtaacattcttcttttgggaagtggatacaaacctccgagctactattgggataactcttcgtatcattggaattctagaagacattatccctgacatttttctgaaagggtaaacttttaaataagttctaaaacagacctaagagtttattatgtcataagtataaaaactg

SEQ ID NO: 419 - DNA, 677 bp, Diabrotica virgifera
  Annotation=Novel protein
tgacacaaatgtattatcaaagtttcatatacctcaaaataggattaaaagtattgaatcatggaaaaacaaaaagggcccgtttagatccttaagtgaaatcttagaagtagatggtttgggtgagaagatgttacataaaatgtgtgaagatataatgaaatgtgataaaccgattgatcagttggctgtaaataataataatggcaagaacaagagaaataagcaaatagtgttacctcctattaatgggagtataataaataatttatctactgcagtgggcatacatttaagtccaataggtatcagttgggcaaaaatatcaaaagaaaataataaattaattagctggaactatgacaactttagttgtttgcccaataaactactcccgaatgaaacatttgacaagaccatccaaattgtacgcaaaataccaccaagtgatgtttacgtatttgaatctagtccatcaatgggtcctcaagcatcaacatcagtgagcttagcatcatcatacaaccaacaactcgaactaaatgcaatgctactagctcttttaaataccagtgtcaatcataatattactttacagagtgtcactaatagagataacccttccacaacaacaatagaaaatagagtattttatttgaagtccaggatatcggcta

SEQ ID NO: 420 - DNA, 464 bp, Diabrotica virgifera
  Annotation=Pogo transposable element with ZNF domain
  SmartBlast Evalue=1E-19; Info=Pogo transposable element with ZNF domain n=1 Tax=Camponotus floridanus RepID=E2AUT7_9HYME
gtttctactgtggtcactaacaatcagatcatggagtatttgcggaggatagtgccgagaatgttccagaatacgctgtctttgttgtcaaggcagatcgatccgaacagtttttggacgaattggtatggcgagaatggttcgggacatcgtccctccaagcattcgacagcgtggtccagcacttagcagaacaaactcggtacgagagcggcatgtcactgatagtgcgtcttaacaaggtcgcccaaaatcccttcaagagttggaacatgggcctccctaatacaccgaaaataccggtggaaaacaatgccataaacgcgacaaacgccacaaacaactccaagaagtcgaggaacgccagaaaaccggaacttccaaagaccccaacacaaacccctcatactttcctttcctccgttaaggtgaaccaggttacaccaacagacgtcaacaaggcc

SEQ ID NO: 421 - DNA, 588 bp, Diabrotica virgifera
  Annotation=Exopolysaccharide synthesis, ExoD; Pfam: PF06055
tccattgtgttgggcgctgaacgccggctttcagctgaaactttgtctggtttcgctgaaattcgcgcacacgcgcgctttttcgattattcacacaataagcttttggcacttttagatttagattagcataattacaggacagttttgttaatttagaataaggttttgtaactattgacaggcagtagaaagttttaaattacagtgcaataatattcacaaacaagttatgtgataagctagaaaaaactatttgtttttttgtgatgaatataataacggcaatgattttctaaggttccatctcaacggtgaaggttcactaagtaaccatcgaaccggcaaccatccctattatttggggcaacagaagaatacagtaatgtccggccaacaggaaagtatcaataaagtggcctcgagcaccggcagcgccagtcaccacaacaaaaggccagtgattctcgtttatcctacggtatcaccggaaacagtagtggttccaatcatttcctgcatcttcggtttcccgcttctagccctcttagtgatatgctgtttgagaagaagagccaagctggccag

SEQ ID NO: 422 - DNA, 583 bp, Diabrotica virgifera
  Annotation=Transcription elongation factor B polypeptide, putative
  SmartBlast Evalue=5E-14; Info=Transcription elongation factor B polypeptide, putative n=1 Tax=Pediculus humanus corporis RepID= E0VE79_PEDHC
ttttcactcgaataatttgagtctgcatcttcctcagtctccattgaagtttcttgagcagctttctcttcttccagaaccatttccttccaagatatcactaagtctttggcaatttctccaacctctcccccaaactttttcaaagcattaaccgtccttcctaccccagtggtttccaaatgggatgtcctaataggaagcttgcctagctttcccagtacatattgtattttatcttcgcttttactagttttatatctttccagtctctcctggtattgaagaatagccttaataacatcatcattagaggaagtcatatttattccgaaaatcacactgtttgttctaattttttgaaatttcactcaaccagctggcaaaattaaattcaaatattcacccatttgactgtagaaaatttgagagcatcattatcaaggctaaaccttttatttttgaacaggttactaatttgtaatattagtacaaaaaatagtagtgaatacaaatatgtaaagaggaaactttacttaaaatcctctttcctcgcgacgtatttttggcagtcttttctctt

SEQ ID NO: 423 - DNA, 282 bp, Diabrotica virgifera
  Annotation=Coiled-coil domain-containing protein 137
  SmartBlast Evalue=0.000000005; Info=Coiled-coil domain- containing protein 137 n=1 Tax=Lepeophtheirus salmonis RepID= C1BSG1_9MAXI
gtcttctggtttgggctgtttgtttcgcttaaacaattctcgctcttcaccttattcttcaaatctataatcctttgaagggtttttgaaacttcttgatgatcaggatttgtaggaggagcattaattttattctttaaactttcgaatctcacagcagcctgcttttctggatctcgaactcctcgatgtttacgtccaggaatttttcttcccattttgatgaagagtattttgtaatgcaaaatacaaataaatcggataaatgatgtcctctccctc

SEQ ID NO: 424 - DNA, 1250 bp, Diabrotica virgifera
  Annotation=Glucocorticoid-induced transcript 1 protein
  SmartBlast Evalue=8E-51; Info=Glucocorticoid-induced transcript 1 protein n=1 Tax=Camponotus floridanus RepID=E2ACM1_9HYME
tacgaaatatttattttaaaaccccgtatatatgtcgccattttacagaacaacccggtaaaacagataaatattatctacacgtttttaaatcggacagaaaacgtttcgaaaactccgtcgaaacgtttgcaatccatcgctttagaaatagataaaaatcaaacagttatagattctattcgtcgatctgagactcttgagagggcactaatggtaaatcttgatcagagctgctgcttttggtgggctgcaaaatctgaaaagcggatcctaagcttggtttcagcttgaatgtgcaaatttgcgggacgtgctctacggtaaaaaactttttgtcgttcagagacttcgactggaccttttcgcaaccatcgggtggttctctcgccaaaaatctgttgatctgtggtgaagatcctagtttattcgtttcttgatccggactagaggcttggctctctcctgatgagttagaactgtgtccgaaattctgaggcgtctgcgtatccacggacctagacctcgaagcgaatttgaacaggtccgccactggggctctgtgtccttctgggatcgtctcggagtatctgtcatgatcgtaggatctgctgatgtgcgcttcactgtcggtcttcaagaccagcctttcgatttcttggttgagaccctccaccgagcttcggatggacgattttggcaatggtttcaaacctatgttcacgggattgaaggtcggggataaaatacaagaggataaagtttgggaactgctgttgagtgtgtgctcgcctggagagccatgcctaatccctaaatctttggtattccatatctttgatctcatggtcggtttctccggtttgtcgtcagtttcggacgaacactgtactatcctcgaatcagacagatccgagtcatcagtctgtacagccttgtccacgtgaagtgtacccatatgcccgtaataatacccttcttttggccattgtccttgaagatagatcgtatctaaggaagcagttcttctgatcgaactgccggtatcttcaggttcggtttttgatttccctttgtatccagctgatccgggactcctctgtccagagttttggtcaggcgatgccctgttcttccagaaataagtcggcgagatagtactactattgccagacatgaaattactactcggcttcatcacagacgaaatcggtatagtggccttcaacggtccctgtttcattaaacca

SEQ ID NO: 425 - DNA, 992 bp, Diabrotica virgifera
  Annotation=24 kDa salivary protein
  SmartBlast Evalue=3E-10; Info=24 kDa salivary protein n=1 Tax= Phlebotomus ariasi RepID=Q2TJC3_9DIPT
aaatcacatgacagatatccatatgtttagttgtgtggtaaaatttaatttaatatttactaatgaattgtgcctataaatctaaatttcgctaaatgaaatggcacaatttgccaaagtatgtttcctcctaatcgtgataatatcgtgtttctcgagagggactgctcaagacaacaacactacaaaaatagtttcaaatcaaacaagccctgttgtatctaaggcattggtgtctaaggaaacaacagaggaaaaaacgaaggtaactacacaacctcctcctaatagtcataagagcagggagcatgtgacaagtgctacagagaaaacattagatgtaacctcaaataaaacatcaaaaaatgtaacaagtgtgaacacaacaacttcagaagtacttgtatctaaaaatgtttctcagcccctaaacattactgtgaacaacgccccaaaagttgtgaacaccacctcaaaattcgtaaactcttccacacaattaactactaatcatacttccagtactaccaaggcaactacaacatctactactattaagccaaaaaaacctttatttactgaacacgacgaagtggtggtagctccagcaaaaccgaacttggatattcctattttagctcatattgatacgactatggaaaagaaggtgagacgggcagactatgtagtgccaattgtagctgttattctgtctgttccacttgtggctgttattctttctgttttttataaaaaaggtaaggattggtggcaacaccgcaactaccggagaatggactatttaattgaaggaatgtacaacagctgaaaaatactcatataatattacgctagtattttagcttagtctttgtatataaatgttgacagattattatgtaatgtgccttttttatatgcaatacttttgtgatattcttgataatacattgttatattttatatattattctattaaaaataaagtatta

SEQ ID NO: 426 - DNA, 644 bp, Diabrotica virgifera
  Annotation=CD151 antigen, putative
  SmartBlast Evalue=1E-17; Info=CD151 antigen, putative n=1 Tax= Pediculus humanus corporis RepID=E0VXQ9_PEDHC
tgcctattgggtgatttttctagtgactttcttgggtgtgaatctgtctttttagtttacttcttctggtttaaaaacaaagcatagtattttagtactagtcgtaaatttgttaaaacatataatacgtttaaagctgtagtgctagatgatataacaaaagtacaaaatctactagaatatgttgctgaactataaatttcagaaatgaagttgtcgatcatcggaaagtagtgcctcggtacctccatttttggtactgtattccccatcatgttttccagactccacttttataaacaaaattattcctagaataatgccaatagcgtgaaaggcactaattcctagtgcggctataaatattatccagaaatttgttttaatttttctgcaacgtagctgatgcatccctcttcatgaatattcgaaggatgatccctgtatccacagtgttcagacacagtcttacagcaggaatcgggaactctgtttaaaacagatccacttttgatccactcattttgtcgccaatctatataattgacagctccacaacaatgtagcttttcctgaatataatcgatggatatcgttttactatcgtcgaattggtaagtgcttattatcgttttgttaaaatt

SEQ ID NO: 427 - DNA, 345 bp, Diabrotica virgifera
  Annotation=Novel protein
attgtgctaccacaggtggtttaatcaaacagtgtccaaacaatcgtcattgctcactttcgatccgtttaacaaactaatcaaatcaacagcaggagttcgagtggtcgagataagaagcgtagagaaagaactggtgttgcacagttgggttttcgatggaagaatcttaaaattttccttccagatcccccaagatattttaaaaggaaccaacagttccagctgcatcgttttcgtggaagacaccatcggatgcatcttgaaggaagaattcagtgtttaactgtaaggcgatcaaaattcgctcatccggaagaaaagtgtaacaacttaaaaaacaac

SEQ ID NO: 428 - DNA, 795 bp, Diabrotica virgifera
  Annotation=WW domain binding protein 4
  SmartBlast Evalue=1E-31; Info=WW domain binding protein 4 n=1 Tax=Bombyx mori RepID=Q1HQ09_BOMMO
gaaccaccttcatttagactctctatggtcttttctttaaactacttttttaactttcttcaggctcataggtcactggacactcaatgtactctggttgtggaggtaactgcagatctacatgactctgttttcttcacttgttgccacaggccataagcatcagtctttacgggttctagaataggtccatagactgtgggggactgtctgctactcttctttctttcagtttttctctttctaacctggctctttcttcttcttcctcctcctttcgtacctgcattaattttaatccatcaattttcttttgcttctccacaagcttcaactgttttgaggtttctccatacttttgttcttcttgttcttgtatgcttaaataaccttctttaggtggctcccaaacagattcattagtcaacgtgttccagtaatagcagttaccatcttctgacttagcttcataccaaactttattctgagtattacttagttgcaggttatcatcttttaactctttgctgattgccatagatgttagatcagcactggaattgctttcgacatctctccgataagctgccatagcagcttgctccatttttttaattgcgcagtccacattttcagcttctttatgagcctttgcactagcttttgtaatttgttttaaacctttcttcacgttttcttggtgtctcctacccttttcatggaagtcccctgctaggtttattatctgcgaaccagcatttacaaaactggcagtattttctttcgtttgatttc

SEQ ID NO: 429 - DNA, 639 bp, Diabrotica virgifera
  Annotation=Angiogenic factor with G patch and FHA domains 1
  SmartBlast Evalue=1E-15; Info=Angiogenic factor with G patch and FHA domains 1 n=1 Tax=Harpegnathos saltator RepID=E2C592_ 9HYME
ggtatggaaaatggaatgtggaattaaataaaatgttgatgttatgattttgttaattgtgaaataaacaaatttataaataaaaatggatatcgaagtagaacagtcggaaacaactaaaactagtgactcttcgtgtagtgaatccgacataatacagaaatgtgatacgaatttaaagaagaaactacttgaagagtttccagaagccctagaatatattaagaagctggaatcaattattaagagacatgtaaagaagattaataaactaaggaacaaattaaaggcaaaagttagatgtaaagaaaatagtacacagaccgatctagaggaatcatattcagctactgataatacagaggctattgaaactgctgaaaacactcagaagagtctagtagacgacattaaagaagcagcagaaattgctatgcaaaaaactgggttcgtctatgaagaaacttcaggactatattatgactataatactggatactattataatgcagaatatggtttgtattatgacggcaccactggcaaatatttgcaatataactctgagacacagacctatgagtatcattcgcaggttgcagtacctagcttggatgcagatagagtagaaaatgctat

SEQ ID NO: 430 - DNA, 2232 bp, Diabrotica virgifera
  Annotation=Novel protein
atattcatttacaatctgcagctgtcgaccctactacaagaaaacaaagaaagctaagacgatattggcaagggaatataaatgaccatcgtcctacaactccaacagtaaatagttatataaatttacgatctagatcaatctgtcctattacaagaagagatcctattataagaagagatcctattataagacgatctaaaagattacaaaaaagcaagagttggagtcaattaaaaaggttgccaaacaacaacagcaacaaaattcagtagtaatatacatatcggattcggattctaacgattgcgtagcagtagatgaatacatgatcgacaaaagacaaataaatacaaaatttccaaagaagtacaacgaatcggatggtgggctaccaccagagagagatgatgatatcatttttgtgcccccaccgccagttgaagttatcacggttgattgtgatgaaacatctctgtgtaacgtagatgacaatagtataaaaaatgctgatgacacagaagattgtgctttggtagaattggattcgtcattaagtaatgattttctggacactgcaaacgtcgatcgtaactcacaattcaattttgatctccatggatctgagttcaccaataacgaagtagtgaccgtacaagacccctcaaaattaactgaatattgtgaaactgaaagtagttgtagtacaaatgaacctaatagaaattttccaatacagtcaaaacgatcgtttttgatgaagttgaatttccaaaagaagcaattttcaatgaaaaagatttagaaagttttggctcattcatagttcctaaaaggacttgtagtaaacgaactgatatttctaatgaagtagatgaacctgaaagtacagcatgtgaagttgccgacgtgtcatctgacagtaacagctcagaaagtgattatgaaactagtacaaaccaaaaatcacatgatttgccttatttatcaccgatggtaacttcagacttaagtaacaagaaaaacaaatctaatgcgaacgagttttttaaagataaaaagaaagaacggaaagattcaaatagttctacaaaaaagaaaaagagagattcagaaaatgaaactagtgatattaattttggaataagttgtattaccagtacaccaaattgttcaaacattaataaaaagaaaaaacatacccatcgccaaagccatgacgaagacattccttcgactattcaagcaaatgatagtttgaacatcgtagataatgatatctcgcataagccaaaaaagaaaaagaagaaagccaagcgtgataaaacgccgaaaagtgatggtgtttttggacaaattttttcagaaactgtggagcctaatgaagacgtagagaccaaaggaacatccaagaaaaagagaaagaaaagaaaaaattctactgaactgtacaacgaaacagttcaacttacctctgattttaatagagataaagatgttccgaatgctgaaactacaatgcactgttctcatgtagttgaattcccgaaatcaaagaaaaagaaaaggcgggcatctgtactgttagtgcgtttggaacgaagcgacattgacaattttgagagattaaaagatttacaagataaaaacgtagatggcaaatctgttttaaagcaaaagaaaaaaaagaaagaaacagctgtatcaaaagtattggataatgattctaatcaacaattaactgacactgaaaacttagttaatgatgatgaacatgaaggagtattaaaatgttcacaagacaaagacataaatcgcaaattagaatcaaagaaaaaaactaaagaaaatgatacatctaatacatcggacaatgattctgatgaacaattatcagcttctaaaacgaaagaaaataatgatgtatctactcatattgcgaagcccaaaaagaaaaagaaggaagtctcagaaagtgaggtggaatctcatgaactcgttaaagaaaatatcgtagatgtggatactactatactattaaaacaaaagaagaaaaagaaagaaacatctatatgtgaagacggggaactgaattctaccgaaaaaagtaaagaattggatgtgtcgaaagaaagtgcatctattaatactgaatcggaaaatgcagacgttgttggttcagctgttgtagaaacaaacgcaactcaagaaattatagaaattgggaataat

SEQ ID NO: 431 - DNA, 562 bp, Diabrotica virgifera
  Annotation=Chloride ion current inducer protein, putative
  SmartBlast Evalue=4E-12; Info=Chloride ion current inducer protein, putative n=1 Tax=Ixodes scapularis RepID=B7P9B2_IXOSC
cacacgacgtgaaagcacattatgctggcaacaagaagagaacaatggttttgctattgaatattcaagtatttccttgcatgccatatctaaagatttaaacatccattctacagaatgtgtataccttgtgacagatggacatattactatgccaggtgacagccctcctgtaattaatgaagatgatgatagtgatgcagagtccactgaagatatatctgaaatattgtttataccgagaaattcagaatcaattccacaaatttatgaagccattaaagtttgtcaagaattgaatccggatcccatggatgaagtaggcgaagatgaattgagtgatgataacgatgacaacttatatgaagatgctgaagacgatatggaaggagaatataatattggtgaaagagggggaggtgatgcagtgtagatgatctttctagaagaatcctgagaaacaatctcaacattcaaataaattatacaaacggcacagctgaagaagatgactttcaagatgccgactgaatattacactaagccggtttatacttttcta

SEQ ID NO: 432 - DNA, 746 bp, Diabrotica virgifera
  Annotation=Tetratricopeptide repeat protein 7B
  SmartBlast Evalue=0.000000004; Info=Tetratricopeptide repeat protein 7B n=1 Tax=Camponotus floridanus RepID=E2ACR7_9HYME
aacataaagtgtatagtgttgtctcgtcattgagagggattccaatgccattacattttattttccacagtttgagtgcttgttccaggtaaattttgaaaagggtaggcgaaatacagcacccctgcttcaatcctttcgtgaccttaaatccctcataatatatccttgatcctgttttaatttttgcagtcgttctattatacagactgctttggactgctttgataaaaccatgtttaatgttggtttgccgtaaggttaaccatagtttgctaaggggcacactgtcatatgctttttgtaagtctacgtaaaccagatgaacttctttattgacggctgttttttctcaataacttgcgtaatagaatactatggaccgcccagctctaaagacagcttgcgctttgcaaattttgtttccatttttattgtttatttaactcattcttaaaagttaccagtatattttacgactatcgaaaatactatatataaatggtaaaatactattattggatgaatttgaagattagctaagtacccgttacttataaacacataggaccttatcgtttttacaaattacctaactattctactcaaaagttattgggaccgaattaaaaggaagaataggactattttgttcttcaaggagagctgtcgccattgcattactggcattttcgtattctccaagagcttcaaggactttgcccaagttgtaccatgtaacatga

SEQ ID NO: 433 - DNA, 569 bp, Diabrotica virgifera
  Annotation=Protein HSPC020 homolog
  SmartBlast Evalue=0.000000004; Info=Protein HSPC020 homolog n=5 Tax=Theria RepID=HS020_BOVIN
ataaagattatatattggttataaaacagtaaataattaagacaacatacttgcatattttacatcgtaattgcctaacacgataaaaagatcaataaaaaatcaaaatcaaataaagtcgtctgaatatcctactagaataaatatgaaatataataatttatcgcacaccatgaccttgaacaagtcttatgctaacatctactggggaactacgttcttgagaaacatccatttcaatttcgtcctcctcttcttcgtcctgtgtttcagattcgtcatcatcgtcattgtcgtcttcgtcatcctcttcttcatcttcctcaatagtctccgaagctgtttttccaattggagtcaaatccgcatttttgtgctttatagacatcagccaatgttcatgatctttttctaattgagtaacttcctcttcatcatcacaaggttgatctacatcaaaccaagatgcatgcatcaagcgaggttttaaatttggaaataatggtatattactcattttatttaatttagatctataattttgcaccctataatttttgcgtagaatc

SEQ ID NO: 434 - DNA, 458 bp, Diabrotica virgifera
  Annotation=NADH dehydrogenase
  SmartBlast Evalue=2E-12; Info=NADH dehydrogenase n=2 Tax= Culicini RepID=B0X8J8_CULQU
attgacagttggctaatgacattaaaagtagaattcctcttttaaatattcagaaacaggtaattccaagttaaatactgatttacataaatttgggatatgttttcttaagtttatggccctaggaattggtcgtctaattaagagatactgcattgtaacaacattacccctctttgtagtgagcagcatttacgcagattataatcgtactcaactatttaaggctaaatccagacgagaaaatgttctatccaattattcctaaaggaattgggtgggccgtctttccagcctttggttttgctctaggttggtacttggataagctagaaacagaacgactttctatgttccgggacaagagcgccctttatggcagagtactcaaggaaggagagaaacctagctggtaattgtagataataattatgtagtaatatagtatgtaaatatgg

SEQ ID NO: 435 - DNA, 494 bp, Diabrotica virgifera
  Annotation= Putative mitochondrial precursor protein; Pfam: PF10161
ggttaacgttagttaattttaccaaaatgttatggagactgggagtgctttataggacaataccaaaattaacaatcccgcctagcataaatagtaacgttgtccgatatgccgtaacaaataaacacggagtagtattgcaggagccccatcgaacctcttttggagtcttcaaaatattcgttacagttacatcaggcttgcttataggagctgcaattagtaaaaatatagccaatttcctagaggagaacgacctttttgtaccatctgatgatgacgatgatgatgactagttaaataactggtgtatgtagtctaatcaaaatcctatttatgtacattacctccgtaccttgttttatttaattatattctatatatgctaattttatttttttaatgtattcgttccagtgaataaaagctttaatcaattcaatctcaatacgttttcattaatctctttacaagtaggtatgagaaaatatatt

SEQ ID NO: 436 - DNA, 539 bp, Diabrotica virgifera
  Annotation=Protein dispatched
  SmartBlast Evalue=6E-11; Info=Protein dispatched n=1 Tax= Harpegnathos saltator RepID=E2BCF5_9HYME
tatattataacatttttaataattgactgacatttatacacagtgctactactggcatcgtttagtccccttaggtggaaatttattgcaatatttttcattcacattcttatccttttgatatcttgaatggtcatcttccataacgttagttgttgacttggattaatggaaaatctcgtgactactagctttatatttgtcgttagtatttgcgagaacgtttattaaactaaggagtatcttgccttgtagatgtagctaacgaatctaactcatgagagtaagattcatcaaaaaattcctctcgagataaacaaagtggttctggcaaaactatttctgcatgcctattagctccaaaactattacgcttgcaacaatgttcaacaggacccacaatagcaagcatggatcccaacatgcacgtggaataaatccaactgactaccataactaacgcgaggaaaatgcccatttgaacgtaaggaagaactatggaaggtatcatgaatgctccggctgatccggttgttatt

SEQ ID NO: 437 - DNA, 526 bp, Diabrotica virgifera
  Annotation=Zinc finger CCHC domain-containing protein 10
  SmartBlast Evalue=3E-12; Info=Zinc finger CCHC domain- containing protein 10 n=2 Tax=Formicidae RepID=E2BAG4_9HYME
aataaaccataaaaataaaacagaagtccaattcaatttaataataataggagttttggagtcctttaaagatgactttgggaaaccattcaaaagcatatttcggtcaaaaaaaaaactccaacgtatccaccacaaggagtccgttgtcagaaatgcttggaatatggccactggagctatgaatgcaaaggaaaaagaaaatatgtacacagatcttcaagaacacaagtattgaaaaagaaactaaaaactaaggaagaaacgactgtcaatagtaatgaagctaatactaatagagaacaatcctcaaaagaaaacaaatcgagtagaaataacagtagttcggaagatagcagttctgattcagagagttcagattctagcagcagtgacagtaattctagcagtagcagttcgtctggaagtagttcgggatcagaaagcgatacggattaatcatatattgtaattttgatattcattatgtgtattttaatgtgatttaaatataatttattcattc

SEQ ID NO: 438 - DNA, 1432 bp, Diabrotica virgifera
  Annotation=Novel protein
tttctgcaattttctctgggcgatcctgatcctggtcctggagttatttgaacattgataagtttatttgaaaatgatagaatatcaacaaatttaaagtatcaagattatgggcgaggaggaaatcacaccaaataatatcaaagaaaatcagagtgagaatatgaatgggaatataaatggtcaagaggaaaatccacctccagaagaaatggatacaaatggggaaaatgatgtaaatgaagatgatctggatgaagacaatgatgacatgtcgcctgaagagtttgctgcacttgatcaccagttagatgccttaaattctgctttagatgacatagaacagaaaaatgataatatacattcgcagttactagaactactccatgctaacagggaaatccggactcaattacagcaagataaagctagcacagataacagagaagacgtaaataaaacaaatgaaccaaaagcatgaaatgtagcattccggtaattatctgacattagatattattcatttgatgcattttgttgtcttttcagtatattctagtgaagaggaaaaccagtattaaaaaaattttcaattattttaactatcagttataaaaataggctatattgttgatttactacattttgtcttacctttatgatgatacatagattagtcatcagctaatatatttttgtttcaatttttttttttcaatttttttaatgtttgacattgttggggtggattttccctattccccctcccctagatccaccactgattagtactatgtgcaaactagtacacttctaaagtaacttaattttccttaaataaatatttaaaacatgactataattattataaacttacatagtatcattaaaattcaaaacttgtttatcaaataaagcaatatgtacctatactgtgtttcaaacgttaaaagtagtatggttgtatattgcaagcgggttttccattctataaattatcataaataatcctctacaagtacctgcctaatactacctttcacggacgctgccataaagagtggcaccgtcgtcaagaaaattctcatttagtttgcatggccccatcctttaaatactgcatcgcatgtctgaaatgctgtaggtactgtataggtataagattccgttaagagccataggtgttttattgcatattttttttattctggtaatttttaaccttttgtcactgtattgagcaatttttcaatatagtataaaaaataatttttgataaaatcgaactttaaagttacaacttaaaaaaaactgttataatactaatagtctatattttttcataattattggatgccagatgattaccaaatatattaagtgatttaaatgttttctaaaaacaccagtattgtttggtttgtatagaata

SEQ ID NO: 439 - DNA, 902 bp, Diabrotica virgifera
  Annotation=Protein HBXIP-like protein
  SmartBlast Evalue=7E-13; Info=Protein HBXIP-like protein n=1 Tax=Harpegnathos saltator RepID=E2C1K2_9HYME
gctgtttaacagtatattttatttttaatgaattacattatattaaaagacttttattttgccttataactatcatatatcattctacaatatatttacaaaaatatcctaaaaaatttctataccctatttttaaactaggagtaattcaaatttaccgcgccatattgcttgtttgtaaatggtccaaccttaagaaagtttactcctctgttatgaaattttgacactattgacatcatagggtaattaagttatatcagcaattttttgtgtttcctgcattattcctttaaaaattgttatttccaaaacagttgtttttagaagtctttagcgacgtattagtaaatacaatatttatggattactgtcaaaggctgacatgatcaaccaaaacagaagatgtatttggtgatttttctagtgacattattgggtgtgaatctgtctttcgagtttactcctcctggtttaaaaacagggtatagatatactcaaaaaataaatgattatgcgatatttaaaaaattgctgtaaaacagatattttatattgtattaaaatgagtcctatagtttagttttgtaaattcttgaaaatagctccagttatagtaccaatcctttgaatagtacatgaacgattatcattttcaaaatgtataactggaggtttactatttggttctatttttaaggcttcctctgcaattgcaccaataatgccagcactgtttgttgtagtttctcctttcattcccaaacagagaccatgtccatctgcaaaaacacatccatacactcctggtgtgttgataagttgtcccattgaatgctctaaattttttccattttatttttgatttgttatcaaaatacaaaagccagttcaagtttctg

SEQ ID NO: 440 - DNA, 452 bp, Diabrotica virgifera
  Annotation=Novel protein
ccgaagaacccaccgcccacgtccccgtcgaacagcaagacgaaccgatgataaccacgtcgtgcagcgaagatcagaacctgaggactcgcggcaagttggaacacctcaggctcgtcatgggtgagagacgagaacggaggagacaacgtaaacagaaaccttattcgctacctcagagtgacactgacactgtcaccgcatgaaacacagcttccttgtacataggttattagtttttattttcgagatggtgaagctgatgagataaggggggtcgaagtaacgtacgtgacgtatggaatagcgtttttttattcttttcaaacagtattcactataataagttagcagctgtttgagacttcctactaaaaattcaaacatctttaaaaatcgtgcatgttttttgtttgttaccccaaactgttaaaaaaataaaataatataac

SEQ ID NO: 441 - DNA, 374 bp, Diabrotica virgifera
  Annotation= DSS1/SEM1 family; Pfam: PF05160
attttcaacagctcaaattgtactgtattctatattaaaatttaatatttaataccttcttaaaacttacaaatcatccataaaatgactgacaaagccaaactggatcttggagttttggaagaggatgacgaattcgaagagtttcccgtcgaggattggtccggcaaagaaaaggacgaacaggatattagtgtatgggaggataactgggaagacgataacgttgaagacgatttcaacaaacaagcccaactcgagaaacagaaagcaaagcctccagcaaaatagaatttataagtgatctaattccatctaaaatgtatatttatctctaattaatgtgtttgtaataaaataataaaaatttgaaa

SEQ ID NO: 442 - DNA, 395 bp, Diabrotica virgifera
  Annotation=Novel protein
cttcttgctgatctcttgctcgggaacgttggataatactttttgtacgtaaggtgatagattggcgaaattgctgagctggtggctgcgtctgggtgtgctcgtcttaaggtccaagtctgcttcgttttctctattgctgcttcctattatggcgtcgaatgcgcccataatagtcggcatcaactccggtgatgagccaaagaaatcttcccaagtgtcatcgttgaactccgactccaccatatttaccagacacctgtactcttaatggcactaggaactaattcacatatttcactgattacaattaacaaacacttaaaaactgtaacagcgtccgtaccggaggattatgcaacttgcatacaaacgcgacctacacctaaagcgat

SEQ ID NO: 443 - DNA, 1148 bp, Diabrotica virgifera
  Annotation=Novel protein
gcgtgacgtttctggtttttatgatcacatttacctgccactcttacggtctagtgcacagggtgaatttattaagtctcagatagatctacttagttgtctctacgggcttttttcttgctggtcttcttagttgccttggattctgtccatgtgtctccaagttcatcaaagacagcaccagtttcttgaggagcagcagcagctttgacaggttcttcaacttttggtggggctgccggtttgggagcaggtacttctttaacttcattcttcacttcttttttgacttcctcttgtttaattttaacttcttcctgtacaggtttctctgaggcttccttcttgggcttcttctctttcttcttcttgtctttcttctcttctacattagcaacttcttcaatttttattggttcttggggttgcttttcttttttctcttctataacttgttttttctcttctgcaatttgtttctcttcctctttaattttcttgttgactacttctttaacaagcttgtccatttcaattttatcagctctggcctctttcacttctttttcctttttggatgattttttatcttttttaactggcgattggtctttcttcttcttatcagatttaagaggtactgtctcccagttgccatcatcaaaatctactggcttctctgacactttgtttaaatttttcttatttttgatttcctctgtctttttgatttcctgttttttaggcttttcattttgtttgtctagtttcttctccttcttttcttgttttgcttcaacagcttctttctggggggacttcttggagtcctttgatggggatttatcagatttttctacattgctgatgtgaccattagcagtaggtttcttttccttagttttacgctttttcccagcagattttctatcgtcaaatgataatttgtcgaagggtggttgttctgcagatttaaaaccaaaagtgaacaccaaaatagctccaacgattactaaagctacaggaatatacagaacatattggctggataattcttgaacgatttccatggttttcaacaaatctgctacaacgagccaccttcaagaaaagatataactaaatttttttggtgacgcggccgtgac

SEQ ID NO: 444 - DNA, 525 bp, Diabrotica virgifera
  Annotation=Mitotic phosphoprotein 67 (Fragment)
  SmartBlast Evalue=3E-11; Info=Mitotic phosphoprotein 67 (Fragment) n=1 Tax=Xenopus laevis RepID=Q8JJ41_XENLA
atttgacatataaatataacctaaaatagtagttaaaaatcgcgggaacagatcactccatacataatccatatcaccatacaagttttattttataaaatctctcttgaatatgtcttctgataacgaatctttgggtgaaaatgaagttggggaacgaactgaacaacactctggatcagaaagtgttaataacatagaggaagaaaggaatgacgatgagaatcaagttgaagataaccagcaaaatgaaagtaaaaaagatgatgatgaagccaagaaaaaagaagttaagcccaaaagaaaactattaaatccgcagcctaaatttgatatacaaactataaggagttctaaaggtttgccagccatttctggacacttcaaagacataaaatataagggaagggacatgaagaacatgatttaaatatattaatgaaaacctatgagtattggtgtcataggttttatcctaaatttacttttgatgatgctattgcaagatttgaatggcttggtaac

SEQ ID NO: 445 - DNA, 552 bp, Diabrotica virgifera
  Annotation=Novel protein
atgggaacaggaaaatgtcaatatgaataatttcgcatgttagtaaatattgatgtttttgtatctgtgctgtgtaactcgaaaatgtaagatgtatacttcgttaaattagcttgaagtctatttgcatgcttcaaaaaatttaatattctaaaattgttacaaacatttatggtaatacctatttacctcattgtgtttaatagcatatttatcttcaacttcaaataaaatatttacagagcatcagttattgaaatagtttgtatttgtatatttgcaactttcaacgtacagatcaaagaaaagaacaaaaccaaaatgtttaaatcatgacaaaggcccaacagaccctaatatgcccaagaagaatatgatagcaaagatatgtccaacctgcaaacaacaggtacctgtggcatgtaagtcttgcccctgtggccattttttctacaatgctagacgcatagctagagagtttgccatagaggcagactataggaggagaactgctagagttcggagagaaaagcctaattattatgatgccct

SEQ ID NO: 446 - DNA, 383 bp, Diabrotica virgifera
  Annotation=CDNA sequence
  SmartBlast Evalue=4E-14; Info=CDNA sequence n=1 Tax=Culex quinquefasciatus RepID=B0WYW7_CULQU
tgagatataaacttgttttttgcagtttccaaaacaatccttccatctcctgatcctagatctaaaagggtaccagttcttcctttgagagcggccaatatatttttaacttgatgatctgtagctggaatatatggtaaacaatattttcgaaatgcaggactgataaatggggcacatattactgtcaaaccaattgcaacacctcctgtgattgctacaaaaaattttccagcgggagatattttctttggaagcgaccgaggctccgtttgttcagatgtttcaaatagagtattcatcggtgcaattaactaaaatacatgtttagggtagaaataattagttattttgtattttaaattttaacataaacataacca

SEQ ID NO: 447 - DNA, 473 bp, Diabrotica virgifera
  Annotation=C2H2-type zinc finger; Pfam: PF13912
accggtgtgctgaccgcacagcatcagggtccagggactacttgatcttttaactaacgaaacgaaaaccctctgacccctcaacctgccggcttaaatatacacgcgctttttactgctttttggtattagtttattttttatgttgggattgactctgttaattttgtttggtgttttcttttcaagtgactgacacagtgacgatgatttagtgaaactattattttttctttggaaatgatagacaaattattttagtgcgcgatagactgccagtctaacaattttcaaaatgagaattaaaatgccagcggtcagaatcgcacaagatgcagatggagtggaagaggatccccatcaagacattctgacctgcggcgtctgtcaaaaacccttcgccctctccgatattgtccgtttattcagcataaagtgacatcctgcaacaagaaaacttcggtcagtgctac

SEQ ID NO: 448 - DNA, 507 bp, Diabrotica virgifera
  Annotation=Novel protein
gataaaaatgggcaacattatattatttttaggtttattttttacgtttttcgtacaagatggtacttccataaaatgttgggactgtcgatctgacctggacccacgttgtggtgatgattttagcaacgaaactcttgttctcacagaatgtaatgttcttagacatgaatgggatggcaccaatgtacccatacaaagttctacctgtatgaaaattattcagacaattaatggtcaaaggataataataagaagttgcgcaatgagtatggatcacataaatttggatgataaacaaagcacttgtataatggatagatataatgctttggagatgaataaatgtagaggtccagattgtcaacatccaattctgtgccataactgtaacgctatactgtccttgtagtgacaaggatggatgtaattctgcttctaatttgaatacatcaatgtatattgctattttcttaacaatattaacactatttctcaaaatatgaa

SEQ ID NO: 449 - DNA, 471 bp, Diabrotica virgifera
  Annotation=Novel protein
gaagtgtcaaacgttttgtctttattgacaatttttgttgaatatacattttgaaatggtattcgtattcggaaattaataataccttctggaaattattgaatagtttgtgcatcagaacaaaaactgtttattttaaacaaaatggaacctactccgcccgataataatggacaacagactaattcacccaatatcccgcaagagatatccgtagacaataatccaccaagtgcagcatccagtccgatatctagtccagtgtgcatggcggctagctcatctcaagaggacattcctcctcccaaagctgactactatgctccacccccgtactgaagtagctacgaagggcaccaagttgccaacatacgaagaggttcaaagagaaaagcacttggaggaacaggataatcccattccggttaattctcctagtacaaggcctttaccatttcgtccagggcagag

SEQ ID NO: 450 - DNA, 689 bp, Diabrotica virgifera
  Annotation=4F5 protein family; Pfam: PF04419
attatccatacataaaatagaaatagcaactgtgattatttgttctagaaaaacgaaaaaggacctgccgtacagaggggaagcttacctgactttaaatagttattgcaactattgaaaatgactcgtggaaatcagcgtgaattagctagggcaaaaaaccaaaagaaacaacaggagcaggctaaaaataaaagaagtgatggactcactctggagcaacgtaaattcagggatgctgagctcatgagggaaaagcagaagaaaaaacaagatgatgaatcgcaaggaagtggccaggcctgtaaataaagtgactttgcaggctctttaatatattttgtataaatttgaacgataattaagatatgttttttacataaccagtgatagtatatgtgaaatatgtaatatattgacgaaaagtgcagtcgaacatcatagtatgtaaattttggtatttgtttaactgttctgttttttttttgtatatattcttaaggggtacatattattcagtatttataatttggatttattaatacttattatacaaatacttgtattacattataacatgtcaactttataatagacaatcattgtttttgcattaattcattgtatcattacagtattttcatcccattaactaactatttctttatatacttctttaatacattctt

What is claimed is:

1. A method of causing mortality or stunting in *Diabrotica* species larvae comprising providing in the diet of the *Diabrotica* species larvae at least one double-stranded RNA (dsRNA) comprising a recombinant polynucleotide comprising at least one silencing element that comprises the nucleotide sequence of SEQ ID NO:76 or the complement thereof, and wherein ingestion of said recombinant polynucleotide by said *Diabrotica* species larvae results in mortality or stunting in said *Diabrotica* species larvae.

2. The method of claim 1, wherein said *Diabrotica* species is at least one selected from the group consisting of *Diabrotica balteata, Diabrotica barberi, Diabrotica beniensis, Diabrotica cristata, Diabrotica curvipustulata, Diabrotica dissimilis, Diabrotica elegantula, Diabrotica emorsitans, Diabrotica graminea, Diabrotica hispanolae, Diabrotica lemniscata, Diabrotica linsleyi, Diabrotica longicornis, Diabrotica milleri, Diabrotica nummularis, Diabrotica occlusa, Diabrotica porracea, Diabrotica scutellata, Diabrotica speciosa, Diabrotica tibialis, Diabrotica trifasciata, Diabrotica undecimpunctata, Diabrotica virgifera*, and *Diabrotica viridula*.

3. The method of claim 1, comprising topically applying to a plant a composition comprising the at least one dsRNA.

4. The method of claim 3, wherein said plant is selected from the group consisting of maize, cucumber, squash, soybeans, and dry beans.

5. The method of claim 3, wherein said composition comprises at least one selected from the group consisting of a solid, liquid, powder, suspension, emulsion, spray, encapsulation, microbeads, carrier particulates, film, matrix, and seed treatment.

6. The method of claim 3, wherein said composition further comprises one or more components selected from the group consisting of a carrier agent, a surfactant, an organosilicone, a polynucleotide herbicidal molecule, a non-polynucleotide herbicidal molecule, a non-polynucleotide pesticide, a safener, and an insect growth regulator.

7. The method of claim 3, wherein said composition further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

8. A composition for controlling a *Diabrotica* species comprising at least one double-stranded RNA (dsRNA) comprising a recombinant polynucleotide comprising at least one silencing element that comprises the nucleotide sequence of SEQ ID NO:76 or the complement thereof.

9. The composition of claim 8, wherein said composition is in the form of at least one selected from the group consisting of a solid, liquid, powder, suspension, emulsion, spray, encapsulation, microbeads, carrier particulates, film, matrix, and seed treatment.

10. The composition of claim 8, further comprising at least one agent selected from the group consisting of a carrier agent, a surfactant, an organosilicone, a polynucleotide herbicidal molecule, a non-polynucleotide herbicidal molecule, a non-polynucleotide pesticide, and a safener.

11. The composition of claim 8, wherein said composition further comprises at least one pesticidal agent selected from the group consisting of a patatin, a plant lectin, a phytoecdysteroid, a *Bacillus thuringiensis* insecticidal protein, a

*Xenorhabdus* insecticidal protein, a *Photorhabdus* insecticidal protein, a *Bacillus laterosporous* insecticidal protein, and a *Bacillus sphearicus* insecticidal protein.

12. A method of providing a plant having improved resistance to a *Diabrotica* species infestation comprising expressing in said plant at least one polynucleotide encoding a double stranded RNA (dsRNA) comprising a silencing element that comprises the nucleotide sequence of SEQ ID NO:76 or the complement thereof.

13. The method of claim 12, further comprising expression in said plant of at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

14. A plant having improved resistance to a *Diabrotica* species infestation, provided by the method of claim 12, wherein the plant comprises the at least one polynucleotide encoding the dsRNA.

15. A seed of the plant of claim 14, wherein the seed comprises the at least one polynucleotide encoding the dsRNA.

16. A recombinant DNA construct comprising a heterologous promoter operably linked to DNA encoding a dsRNA, the DNA comprising at least one segment that comprises the nucleotide sequence of SEQ ID NO:76 or the DNA complement thereof.

17. A transgenic plant cell having in its genome the recombinant DNA construct of claim 16.

18. A transgenic plant comprising the transgenic plant cell of claim 17.

* * * * *